US010781435B2

(12) United States Patent
Madison et al.

(10) Patent No.: US 10,781,435 B2
(45) Date of Patent: Sep. 22, 2020

(54) MODIFIED MEMBRANE TYPE SERINE PROTEASE 1 (MTSP-1) POLYPEPTIDES AND METHODS OF USE

(71) Applicant: CATALYST BIOSCIENCES, INC., South San Francisco, CA (US)

(72) Inventors: Edwin L. Madison, San Francisco, CA (US); Vanessa Soros, San Francisco, CA (US); Mikhail Popkov, San Diego, CA (US)

(73) Assignee: Catalyst Biosciences, Inc., South San Francisco, CA (US)

( * ) Notice: Subject to any disclaimer, the term of this patent is extended or adjusted under 35 U.S.C. 154(b) by 132 days.

(21) Appl. No.: 16/015,093

(22) Filed: Jun. 21, 2018

(65) Prior Publication Data

US 2019/0093097 A1   Mar. 28, 2019

Related U.S. Application Data

(60) Provisional application No. 62/523,735, filed on Jun. 22, 2017, provisional application No. 62/664,051, filed on Apr. 27, 2018.

(51) Int. Cl.
| | | |
|---|---|---|
| *C12N 9/64* | (2006.01) | |
| *C07K 14/435* | (2006.01) | |
| *A61K 45/06* | (2006.01) | |
| *A61K 31/397* | (2006.01) | |
| *A61K 38/00* | (2006.01) | |

(52) U.S. Cl.
CPC .......... *C12N 9/6424* (2013.01); *A61K 31/397* (2013.01); *A61K 45/06* (2013.01); *C07K 14/435* (2013.01); *C12Y 304/21109* (2013.01); *A61K 38/00* (2013.01)

(58) Field of Classification Search
None
See application file for complete search history.

(56) References Cited

U.S. PATENT DOCUMENTS

| | | | |
|---|---|---|---|
| 4,002,531 A | 1/1977 | Royer | 195/68 |
| 4,044,126 A | 8/1977 | Cook et al. | 514/180 |
| 4,179,337 A | 12/1979 | Davis et al. | 435/181 |
| 4,364,923 A | 12/1982 | Cook et al. | 424/46 |
| 4,522,811 A | 6/1985 | Eppstein et al. | 514/2.4 |
| 4,892,538 A | 1/1990 | Aebischer et al. | 604/891.1 |
| 4,952,496 A | 8/1990 | Studier et al. | 435/91.41 |
| 4,980,286 A | 12/1990 | Morgan et al. | 435/172.3 |
| 5,122,614 A | 6/1992 | Zalipsky | 548/520 |
| 5,183,550 A | 2/1993 | Mattiessen | 204/415 |
| 5,283,187 A | 2/1994 | Aebischer et al. | 435/182 |
| 5,324,844 A | 6/1994 | Zalipsky | 548/520 |
| 5,446,090 A | 8/1995 | Harris | 525/54.1 |
| 5,457,035 A | 10/1995 | Baum et al. | 435/69.5 |
| 5,612,460 A | 3/1997 | Zalipsky | 530/391.9 |
| 5,643,575 A | 7/1997 | Martinez et al. | 424/194.1 |
| 5,672,662 A | 9/1997 | Harris et al. | 525/408 |
| 5,766,581 A | 6/1998 | Bartley et al. | 424/85.1 |
| 5,792,616 A | 8/1998 | Persico et al. | 435/7.21 |
| 5,795,569 A | 8/1998 | Bartley et al. | 424/85.1 |
| 5,808,096 A | 9/1998 | Zalipsky | 548/520 |
| 5,900,461 A | 5/1999 | Harris | 525/54.11 |
| 5,919,455 A | 7/1999 | Greenwald et al. | 424/178.1 |
| 5,932,462 A | 8/1999 | Harris et al. | 435/188 |
| 5,985,263 A | 11/1999 | Lee et al. | 424/85.2 |
| 5,990,237 A | 11/1999 | Bentley et al. | 525/54.2 |
| 6,113,906 A | 9/2000 | Greenwald et al. | 424/194.1 |
| 6,214,966 B1 | 4/2001 | Harris | 528/322 |
| 6,258,351 B1 | 7/2001 | Harris | 424/78.3 |
| 6,340,742 B1 | 1/2002 | Burg et al. | 530/351 |
| 6,413,507 B1 | 7/2002 | Bentley et al. | 424/78.02 |
| 6,420,339 B1 | 7/2002 | Gegg et al. | 514/12 |
| 6,437,025 B1 | 8/2002 | Harris et al. | 523/406 |
| 6,448,369 B1 | 9/2002 | Bentley et al. | 528/425 |

(Continued)

FOREIGN PATENT DOCUMENTS

| | | |
|---|---|---|
| AU | 2011 218 753 | 9/2011 |
| EP | 0 822 199 | 9/2004 |

(Continued)

OTHER PUBLICATIONS

Letter/Written Disclosure of the Supplemental Information Disclosure Statement for the above-referenced application filed herewith on April 3, 2020, 2 pages
Catalyst Biosciences Press Release, entitled "Catalyst Biosciences Announces 1-for-15 Reverse Stock Split," Published Feb. 10, 2017 [online]; retrieved on Mar. 29, 2017, from: <URL:ir.catalystbiosciences.com/phoenix.zhtml?c=254141&p=irol-newsArticle&Id=2245124, 4 pages.
Catalyst Biosciences Press Release, entitled "Catalyst Biosciences Reports Fourth Quarter and Full Year 2016 Financial Results and Provides Corporate Update," Published Mar. 8, 2017 [online]; retrieved on Mar. 29, 2017 from: <URL:ir.catalystbiosciences.com/phoenix.zhtml?c=254141&p=irol-newsArticle&Id=2252461, 5 pages.

(Continued)

*Primary Examiner* — Suzanne M Noakes
*Assistant Examiner* — Jae W Lee
(74) *Attorney, Agent, or Firm* — Dentons US LLP; Stephanie Seidman

(57) ABSTRACT

Provided are MTSP-1 polypeptides modified to have altered activity and/or specificity so that they cleave a complement protein, such as complement protein C3, to inhibit its activity and thereby inhibit complement activation. The modified MTSP-1 polypeptides that inhibit complement activation can be used for treatment of diseases and conditions in which complement activation plays a role. Such diseases and conditions include inflammatory diseases and diseases with an inflammatory component. Exemplary of these disorders are ischemic and reperfusion disorders, including myocardial infarction and stroke, sepsis, autoimmune diseases, ophthalmic disorders, such as diabetic retinopathies and macular degeneration, including age-related macular degeneration (AMD), and transplanted organ rejection, such as renal delayed graft function (DGF).

38 Claims, 2 Drawing Sheets

Specification includes a Sequence Listing.

(56) References Cited

U.S. PATENT DOCUMENTS

| | | | |
|---|---|---|---|
| 6,461,802 B1 | 10/2002 | Van Thillo et al. | 430/336 |
| 6,495,659 B2 | 12/2002 | Bentley et al. | 528/425 |
| 6,737,505 B2 | 5/2004 | Bentley et al. | 528/425 |
| 6,828,401 B2 | 12/2004 | Nho et al. | 526/333 |
| 6,858,736 B2 | 2/2005 | Nho et al. | 546/290 |
| 7,700,341 B2 | 4/2010 | Madison et al. | 435/212 |
| 7,939,304 B2 | 5/2011 | Ruggles | 435/183 |
| 8,211,428 B2 | 7/2012 | Madison | 424/94.64 |
| 8,445,245 B2 | 5/2013 | Ruggles et al. | 435/183 |
| 8,663,633 B2 | 3/2014 | Madison et al. | 424/94.64 |
| 9,290,757 B2 | 3/2016 | Madison | 424/94.64 |
| 9,359,598 B2 | 6/2016 | Ruggles et al. | 453/183 |
| 9,795,655 B2 | 10/2017 | Madison et al. | |
| 2001/0021763 A1 | 9/2001 | Harris | 528/75 |
| 2001/0044526 A1 | 11/2001 | Shen | 530/409 |
| 2001/0046481 A1 | 11/2001 | Bentley et al. | 424/78.18 |
| 2002/0052430 A1 | 5/2002 | Harris et al. | 523/406 |
| 2002/0072573 A1 | 6/2002 | Bentley et al. | 525/409 |
| 2002/0156047 A1 | 10/2002 | Zhao | 514/58 |
| 2003/0114647 A1 | 6/2003 | Harris et al. | 530/402 |
| 2003/0119168 A1 | 6/2003 | Madison | 435/226 |
| 2003/0143596 A1 | 7/2003 | Bentley et al. | 435/6 |
| 2003/0158333 A1 | 8/2003 | Roberts et al. | 525/54.11 |
| 2003/0220447 A1 | 11/2003 | Harris | 525/54.1 |
| 2004/0013637 A1 | 1/2004 | Bentley et al. | 424/78.17 |
| 2004/0146938 A1 | 7/2004 | Nguyen et al. | 435/7.1 |
| 2004/0235734 A1 | 11/2004 | Bossard et al. | 530/383 |
| 2005/0114037 A1 | 5/2005 | Desjarlais et al. | 702/19 |
| 2005/0171328 A1 | 8/2005 | Harris | 528/322 |
| 2005/0209416 A1 | 9/2005 | Harris | 525/523 |
| 2005/0260756 A1 | 11/2005 | Troy et al. | 435/450 |
| 2006/0002916 A1 | 1/2006 | Ruggles et al. | 424/94.63 |
| 2006/0024289 A1 | 2/2006 | Ruggles et al. | 424/94.64 |
| 2006/0024298 A1 | 2/2006 | Lazar et al. | 424/133.1 |
| 2006/0100134 A1 | 5/2006 | Guo et al. | 514/2 |
| 2006/0104968 A1 | 5/2006 | Bookbinder et al. | 424/94.61 |
| 2006/0178297 A1 | 8/2006 | Troy et al. | 514/7 |
| 2006/0222657 A1 | 10/2006 | Dowdy et al. | 424/186.1 |
| 2007/0093443 A1 | 4/2007 | Madison | 514/44 |
| 2007/0129305 A1 | 6/2007 | Divita et al. | 514/13 |
| 2007/0161595 A1 | 7/2007 | Bumcrot et al. | 514/44 |
| 2009/0136477 A1 | 5/2009 | Nguyen | 424/94.64 |
| 2010/0105121 A1 | 4/2010 | Madison et al. | 435/219 |
| 2010/0189652 A1 | 7/2010 | Pollock et al. | 424/9.1 |
| 2012/0244139 A1 | 9/2012 | Madison et al. | 424/94.63 |
| 2014/0242062 A1 | 8/2014 | Madison et al. | 424/94.63 |

FOREIGN PATENT DOCUMENTS

| | | |
|---|---|---|
| EP | 1 064 951 | 8/2007 |
| EP | 1 867 661 | 12/2007 |
| WO | WO 1993/010151 | 5/1993 |
| WO | WO 1994/028024 | 12/1994 |
| WO | WO 2000/002017 | 1/2000 |
| WO | WO 2000/062067 | 10/2000 |
| WO | WO 2001/032711 | 5/2001 |
| WO | WO 2001/087925 | 11/2001 |
| WO | WO 2002/049673 | 6/2002 |
| WO | WO 2003/035892 | 5/2003 |
| WO | WO 2005/000360 | 1/2005 |
| WO | WO 2005/063816 | 7/2005 |
| WO | WO 2007/053512 | 5/2007 |
| WO | WO 2007/097561 | 8/2007 |
| WO | WO 2008/045148 | 4/2008 |
| WO | WO 2015/085395 | 6/2015 |
| WO | WO 2015/166427 | 11/2015 |

OTHER PUBLICATIONS

Catalyst Biosciences, United States Securities and Exchange Commission filing, dated Mar. 13, 2017 [online]; retrieved on Aug. 1, 2018, from: <URL:sec.gov/Archives/edgar/data/1124105/000119312517080510/d358624ds1.htm, 79 pages.

Catalyst Biosciences Press Release, entitled "Catalyst Biosciences Reports First Quarter 2017 Financial Results and Provides Corporate Update," Published May 11, 2017 [online]; retrieved on May 25, 2017 from <URL:ir.catalystbiosciences.com/phoenix.zhtml?c=254141&p=irol-newsArticle_print&ID=2272266, 5 pages.

Catalyst Biosciences Press Release, entitled "Catalyst Biosciences Reports Second Quarter 2017 Financial Results and Provides Subcutaneous (SQ) Hemophilia Program Update," published Aug. 3, 2017 [online]; retrieved on Jan. 30, 2018 from: <URL:ir.catalystbiosciences.com/phoenix.zhtml?c=254141&p=irol-newsArticle_print&ID=2291512, 4 pages.

Catalyst Biosciences Press Release, entitled "Catalyst Biosciences Reports Third Quarter 2017 Operating & Financial Results and Provides Corporate Update," published Nov. 2, 2017 [online]; retrieved on Jan. 30, 2018 from: <URL:ir.catalystbiosciences.com/phoenix.zhtml?c=254141&p=irol-newsArticle_print&ID=2313857, 3 pages.

Catalyst Biosciences Press Release, entitled "Catalyst Biosciences Reports Fourth Quarter and Full-Year 2017 Operating & Financial Results and Provides Corporate Update," published Mar. 1, 2018 [online]; retrieved on Jul. 17, 2018 from: <URL:ir.catalystbiosciences.com/phoenix.zhtml?c=254141&p=irol-newsArticle_print&ID=2335633, 5 pages.

Catalyst Biosciences Press Release, entitled "Catalyst Biosciences Reports First Quarter Operating & Financial Results and Provides Corporate Update," published May 3, 2018 [online]; retrieved on Jul. 17, 2018 from: <URL:ir.catalystbiosciences.com/phoenix.zhtml?c=254141&p=irol-newsArticle_print&ID=2346752, 5 pages.

Catalyst Biosciences, United States Securities and Exchange Commission filing, dated May 3, 2018; Retrieved on Jul. 31, 2018, from: <URL:getfilings.com/sec-filings/180503/CATALYST-BIOSCIENCES-INC 10-Q/, 32 pages.

Catalyst Biosciences, United States Securities and Exchange Commission filing, dated Mar. 7, 2019; retrieved on Mar. 28, 2019, from: <URL:ir.catalystbiosciences.com/static-files/3ab468bc-227c-46e5-8598-54025b55f93a, 155 pages.

Furfine et al., Catalyst Biosciences Poster Abstract, entitled "Pegylated CB 2782: a Complement Factor C3-Inactivating Protease and Potential Long-Acting Treatment for Dry AMD," Poster No. A0251, presented at the 2019 Annual Meeting of the Association for Research in Vision and Ophthalmology (ARVO), Vancouver, British Columbia, on Apr, 28, 2019; retrieved on Mar, 28, 2019 from: <URL:eventpilot.us/web/page.php?nav=false&page=IntHml&project=ARVO19&id=3155125, 2 pages Catalyst Biosciences Press Release, entitled "Catalyst Biosciences & Mosaic Biosciences Present Preclinical Data on Pegylated CB 2782 for the Treatment of Dry Age-Related Macular Degeneration," Published Apr. 29, 2019 [online]; retrieved on Apr. 29, 2019, from: <URL:ir.catalystbiosciences.com/news-releases/news-release-details/catalyst-biosciences-mosaic-biosciences-present-preclinical-data, 2 pages.

Furfine et al., Catalyst Biosciences Poster, entitled "CB 27 82-PEG: a Complement Factor C3-Inactivating Protease and Potential Long-Acting Treatment for Dry AMD," Poster No. A0251, presented at the 2019 Annual Meeting of the Association for Research in Vision and Ophthalmology (ARVO), Vancouver, British Columbia, on Apr 28, 2019 [poster and individual panels], 9 pages Catalyst Biosciences Presentation, entitled "Corporate Overview," presented on Apr. 9, 2019; retrieved on Aug. 1, 2019, from: <URL:ir.catalystbiosciences.com/static-files/96f2e8ad-6334-4f5e-89e4-a0df25aaf1c7, 27 pages.

Catalyst Biosciences Press Release, entitled "Catalyst Biosciences Reports First Quarter 2019 Operating & Financial Results and Provides a Corporate Update," Published May 2, 2019 [online]; retrieved on Aug. 1, 2019, from: <URL:ir.catalystbiosciences.com/news-releases/news-release-details/catalyst-biosciences-reports-first-quarter-2019-operating, 5 pages.

Catalyst Biosciences, United States Securities and Exchange Commission filing, dated May 2, 2019; retrieved on Aug. 1, 2019, from: <URL:ir.catalystbiosciences.com/static-files/839f0b21-034a-46e1-93d6-b02a9df870ef, 28 pages.

(56) References Cited

OTHER PUBLICATIONS

Catalyst Biosciences Presentation, entitled "Corporate Overview," presented on Jun. 4, 2019; retrieved on Aug. 1, 2019, from: <URL:ir.catalystbiosciences.com/static-files/6c9d2c7b-7a6b-4854-9338-50072b6Ocb3b, 25 pages.
Blouse, G. E., Catalyst Biosciences Presentation, entitled "Molecular Evolution and Design of Pegylated CB 2782 as a Complement Factor C3-Inactivating Protease for Dry AMD," presented at the ASBMB Symposium on Serine Proteases and Extracellular Proteolysis meeting in Potomac, Maryland on Sep. 15, 2019, 16 pages.
Catalyst Biosciences Press Release, entitled "Catalyst Biosciences Reports Third Quarter 2019 Operating & Financial Results and Provides a Corporate Update," Published Nov. 7, 2019 [online]; retrieved on Jan. 24, 2020, from: <URL:ir.catalystbiosciences.com/news-releases/news-release-details/catalyst-biosciences-reports-third-quarter-2019-operating, 6 pages.
Blouse, G.E., Catalyst Biosciences Presentation, entitled "CB 2782-PEG: a Complement Factor C3-Inactivating Protease and Potential Long-Acting Treatment for Dry AMD," presented at the Complement-based Drug Development Summit in Boston, MA, on Nov. 15, 2019, 15 pages.
Catalyst Biosciences Presentation, entitled "Corporate Overview," presented on Nov. 19, 2019, at the Stifel 2019 Healthcare Conference, 27 pages.
Catalyst Biosciences Press Release, entitled "Catalyst Biosciences Announces Global License and Collaboration Agreement to Develop Pegylated CB 2782 for the Treatment of Dry Age-Related Macular Degeneration," Published Dec. 19, 2019 [online]; retrieved on Jan. 24, 2020, from: <URL:ir.catalystbiosciences.com/news-releases/news-release-details/catalyst-biosciences-announces-global-license-and-collaboration, 2 pages.
Catalyst Biosciences Investor Presentation, entitled "Corporate Overview," presented on Jan. 8, 2020, 26 pages.
Catalyst Biosciences Investor Presentation, entitled "Corporate Overview," presented on Jan. 13, 2020, 31 pages.
Catalyst Biosciences Press Release, entitled "Catalyst Biosciences Announces Addition of Geoffrey Shiu Fei Ling, M.D. and Sharon Tetlow to Board of Directors," Published Jan. 17, 2020 [online]; retrieved on Jan. 24, 2020, from: <URL:ir.catalystbiosciences.com/news-releases/news-release-details/catalyst-biosciences-announces-addition-geoffrey-shiu-fei-ling, 3 pages.
Catalyst Biosciences Investor Presentation, entitled "Corporate Overview," presented on Feb. 7, 2020, 27 pages.
Catalyst Biosciences Press Release, entitled "Catalyst Biosciences Announces Proposed Public Offering of Common Stock." Published Feb. 12, 2020 [online]; retrieved on Mar. 11, 2020, from: <URL:ir.catalystbiosciences.com/news-releases/news-release-details/catalyst-biosciences-announces-proposed-public-offering-common-1, 2 pages.
Catalyst Biosciences Press Release, entitled "Catalyst Biosciences Announces Pricing of Public Offering of Common Stock." Published Feb. 13, 2020 [online]; retrieved on Mar. 11, 2020, from: <URL:ir.catalystbiosciences.com/news-releases/news-release-details/catalyst-biosciences-announces-pricing-public-offering-common-1, 3 pages.
Catalyst Biosciences Press Release, entitled "Catalyst Biosciences Announces Closing of Public Offering of Common Stock." Published Feb. 18, 2020 [online]; retrieved on Mar. 11, 2020, from: <URL:ir.catalystbiosciences.com/news-releases/news-release-details/catalyst-biosciences-announces-closing-public-offering-common-1, 2 pages.
Catalyst Biosciences Press Release, entitled "Catalyst Biosciences Reports Fourth Quarter and Full-Year 2019 Operating & Financial Results and Provides a Corporate Update" Published Feb 20, 2020 [online]; retrieved on Mar 11, 2020, from: <URL:ircatalystbiosciences.com/news-releases/news-release-details/catalyst-biosciences-reports-fourth-quarter-and-full-year-2019, 6 pages
Catalyst Biosciences Presentation, entitled "Corporate Overview." Presented at the Cowen Healthcare Conference, on Mar. 3, 2020, in Boston, MA, 29 pages.

Response, filed Apr. 23, 2019, to International Search Report and Written Opinion, dated Dec. 10, 2018, in connection with corresponding International Patent Application No. PCT/US2018/038844, 95 pages.
Written Opinion of the International Preliminary Examining Authority, dated Jun. 21, 2019, in connection with corresponding International Patent Application No. PCT/US2018/038844, 15 pages.
International Preliminary Report on Patentability (Chapter II), dated Oct. 1, 2019, in connection with corresponding International Patent Application No. PCT/US2018/038844, 18 pages.
U.S. Appl. No. 15/084,387, filed Mar. 29, 2016, 2016/0201047, Jul. 14, 2016.
U.S. Appl. No. 15/258,908, filed Sep. 7, 2016, 2016/0376577, Dec. 29, 2016.
Letter/Written Disclosure of the Information Disclosure Statement for the above-referenced application, filed herewith on Aug 8, 2018, 2 pages
Adams et al., "The c-myc oncogene driven by immunoglobulin enhancers induces lymphoid malignancy in transgenic mice," Nature 318:533-538 (1985).
Akkarawongsa et al., "Inhibition of Herpes Simplex Virus Type 1 Infection by Cationic β-Peptides," Antimicrob. Agents and Chemother. 52(6):2120-2129 (2008).
Alef et al., "Ichthyosis, Follicular Atrophoderma, and Hypotrichosis Caused by Mutations in ST14 Is Associated with Impaired Profilaggrin Processing," J. Invest. Dermatol. 129(4):862-869 (2009).
Alexander et al., "Expression of the c-myc oncogene under control of an immunoglobulin enhancer in Eμ-myc transgenic mice," Mol. Cell. Biol. 7(4):1436-1444 (1987).
Anderson et al., "A Role for Local Inflammation in the Formation of Drusen in the Aging Eye," Am. J. Ophthalmol 134(3):411-31 (2002).
Anderson et al., "The Pivotal Role of the Complement System in Aging and Age-related Macular Degeneration: Hypothesis Revisited," Prog. Retin. Eye Res. 29(2):95-112 (2010).
Asgari et al., "Complement in organ transplantation," Curr. Opin. Organ Transplant. 15(4):486-491 (2010).
Austen et al., "The role of complement and natural antibody in intestinal ischemia-reperfusion injury," Int. J. Immunopathol. Pharmacol. 16(1):1-8 (2003).
Barrett, A. J., "An introduction to the proteinases," In: Proteinase Inhibitors, Barrett, A.J. and Salvensen, G., eds., Elsevier, Amsterdam, pp. 3-22 (1986).
Basel-Vanagaite et al., "Autosomal Recessive Ichthyosis with Hypotrichosis Caused by a Mutation in ST14, Encoding Type II Transmembrane Serine Protease Matriptase," Am. J. Hum. Genet. 80:467-477 (2007).
Benaud et al., "Regulation of the activity of matriptase on epithelial cell surfaces by a blood-derived factor," Eur. J. Biochem. 268:1439-1447 (2001).
Benhar et al., "Pseudomonas Exotoxin A Mutants. Replacement of surface-exposed residues in domain III with cysteine residues that can be modified with polyethylene glycol in a site-specific manner," J. Biol. Chem. 269:13398-13404 (1994).
Benoist, C. and P. Chambon, "In vivo sequence requirements of the SV40 early promoter region," Nature 290:304-310 (1981).
Bhole et al., "Therapeutic potential of targeting the complement cascade in critical care medicine," Crit. Care Med. 31(Suppl. 1):S97-S104 (2003).
Bitter et al., "Expression and Secretion Vectors for Yeast," Methods Enzymol. 153:516-544 (1987).
Bradley et al., "Complement in age-related macular degeneration: a focus on function," Eye 25:683-693 (2011).
Brinster et al., "Regulation of metallothionein-thymidine kinase fusion plasmids injected into mouse eggs," Nature 296:39-42 (1982).
Brumeanu et al., "Derivatization with Monomethoxypolyethylene Glycol of Igs Expressing Viral Epitopes Obviates Adjuvant Requirements," J. Immunol. 154:3088-3095 (1995).
Buerke et al., "Novel Small Molecule Inhibitor of C1s Exerts Cardioprotective Effects in Ischemia-Reperfusion Injury in Rabbits," J. Immunol. 167:5375-5380 (2001).
Buyon et al., "Assessment of disease activity and impending flare in patients with systemic lupus erythematosus. Comparison of the use

(56) References Cited

OTHER PUBLICATIONS of complement split products and conventional measurements of complement," Arthritis Rheum. 35(9):1028-1037 (1992).
Caliceti, P. and F. Veronese, "Pharmacokinetic and biodistribution properties of poly(ethylene glycol)-protein conjugates," Adv. Drug Deliv. Rev. 55(10):1261-1277 (2003).
Carrillo, H. and D. Lipman, "The multiple sequence alignment problem in biology," SIAM J. Appl. Math. 48:1073-1082 (1988).
Castellano et al., "Therapeutic Targeting of Classical and Lectin Pathways of Complement Protects from Ischemia-Reperfusion-Induced Renal Damage," Am. J. Pathol. 176(4):1648-1659 (2010).
Chapman et al., "Therapeutic antibody fragments with prolonged in vivo half-lives," Nat. Biotechnol. 17(8):780-783 (1999).
Chi et al., "Chapter 9. Suppression of Drusen Formation by Compstatin, a Peptide Inhibitor of Complement C3 activation, on Cynomolgus Monkey with Early-Onset Macular Degeneration," Adv. Exp. Med. Biol. 703:127-135 (2010).
Coffey et al., "Complement factor H deficiency in aged mice causes retinal abnormalities and visual dysfunction," Proc. Nat. Acad. Sci. 104(42):16651-16656 (2007).
Colbere-Garapin et al., "A New Dominant Hybrid Selective Marker for Higher Eukaryotic Cells," J.Mol. Biol. 150:1-14 (1981).
Couser et al., "The Effects of Soluble Recombinant Complement Receptor 1 on Complement-Mediated Experimental Glomerulonephritis," J. Am. Soc. Nephrol. 5:1888-1894 (1995).
Crabb et al., "Drusen proteome analysis: An approach to the etiology of age-related macular degeneration," Proc. Natl. Acad. Sci. 99(23):14682-14687 (2002).
Damman et al., "Local renal complement C3 induction by donor brain death is associated with reduced renal allo graft function after transplantation," Nephrol. Dial. Transplant. 26(7):2345-2354 (2011).
Danobeitia et al., "Complement Blockade Prevents Delayed Graft Function Model of Kidney Allo-Transplantation," Abstract No. 119, Am. J. Transplant. 13 (suppl 5), American Transplant Congress, May 18-22, 2013, Seattle, Washington, 4 pages.
DeBoer et al., "The tac promoter: a functional hybrid derived from the trp and lac promoters," Proc. Natl. Acad. Sci. U.S.A. 80:21-25 (1983).
Deng et al., "Projecting human pharmacokinetics of therapeutic antibodies from nonclinical data," mAbs 3(1):61-66 (2011).
Derossi et al., "Cell Internalization of the Third Helix of the Antennapedia Homeodomain Is Receptor-independent," J. Biol. Chem. 271(30):18188-18193 (1996).
Desilets et al., "Mutation G827R in Matriptase Causing Autosomal Recessive Ichthyosis with Hypotrichosis Yields an Inactive Protease," J. Biol. Chem. 283(16):10535-10542 (2008).
Edwards et al., "Complement Factor H Polymorphism and Age-Related Macular Degeneration," Science 308(5720):421-424 (2005).
Elliott, G. and P. O'Hare, "Intercellular Trafficking and Protein Delivery by a Herpesvirus Structural Protein," Cell 88:223-233 (1997).
Englebienne, P., "Use of colloidal gold surface plasmon resonance peak shift to infer affinity constants from the interactions between protein antigens and antibodies specific for single or multiple epitopes," Analyst 123:1599-1603 (1998).
Evan et al., "Isolation of Monoclonal Antibodies Specific for Human c-myc Proto-Oncogene Product," Mol. Cell. Biol. 5(12):3610-3616 (1985).
Felix et al., "Pegylated peptides IV. Enhanced biological activity of site-directed pegylated GRF analogs," Int. J. Peptide Protein Res. 46(3-4):253-264 (1995).
Fiane et al., "Compstatin, a peptide inhibitor of C3, prolongs survival of ex vivo perfused pig xenographs," Xenotransplantation 6:52-65 (1999).
Field et al., "Purification of a RAS-Responsive Adenylyl Cyclase Complex from *Saccharomyces cerevisiae* by Use of an Epitope Addition Method," Mol. Cell. Biol. 8(5):2159-2165 (1988).
Fletcher et al., "Studying Age-Related Macular Degeneration Using Animal Models," Optm. Vis.Sci. 91(8):878-886 (2014).
Forest et al., "Cellular models and therapies for age-related macular degeneration," Disease Models and Mechanisms 8(5):421-427 (2015).
Friedrich et al., "Catalytic domain structures of MT-SP1/matriptase, a matrix-degrading transmembrane serine proteinase," J. Biol. Chem. 277(3):2160-2168 (2002).
Futaki et al., "Arginine-rich Peptides. An abundant source of membrane-permeable peptides having potential as carriers for intracellular protein delivery," J. Biol. Chem. 276(8):5836-5840 (2001).
Futaki et al., "Membrane permeability commonly shared among arginine-rich peptides," J. Mol. Recognit. 16:260-264 (2003).
Gaboriaud et al., "The crystal structure of the globular head of complement protein C 1q provides a basis for its versatile recognition properties," J. Biol. Chem. 278(47):46974-46982 (2003).
Gardner et al., "The complete nucleotide sequence of an infectious clone of cauliflower mosaic virus by M13mp7 shotgun sequencing," Nucleic Acids Res. 9(12):2871-2888 (1981).
Gass, J. D., "Drusen and disciform macular detachment and degeneration," Trans. Am. Ophthalmol. Soc. 70: 409-36 (1972).
Ge et al., "Protein Interaction Analysis of ST14 Domains and Their Point and Deletion Mutants," J. Biol. Chem. 281(11):7406-7412 (2006).
Gemenetzi, M. and A. J. Lotery, "Complement pathway biomarkers and age-related macular degeneration," Eye 30:1-14 (2016).
Genbank Accession No. AAD42765, "Matriptase [*Homo Sapiens*]," Published on Dec. 30, 1999 [online] [retrieved on Jun. 29, 2018] Retrieved from:<URL:ncbi.nlm.nih.gov/protein/AAD42765 [3 pages].
Genbank Accession No. AF118224, "*Homo sapiens* matriptase mRNA, complete cds," Published on Dec. 30, 1999 [online] [retrieved on Jun. 29, 2018] Retrieved from:<URL:ncbi.nlm.nih.gov/nuccore/AF118224 [2 pages].
Ghosh et al., "Role of Complement and Complement Regulatory Proteins in the Complications of Diabetes," Endocr. Rev. 36(3):272-288 (2015).
Gilbert, W. and L. Villa-Komaroff, "Useful proteins from recombinant bacteria," Sci. Am. 242:74-94 (1980).
Gold et al., "Variation in factor B (BF) and complement component 2 (C2) genes is associated with age-related macular degeneration," Nat. Genet. 38(4):458-462 (2006).
Gribskov, M. and R. Burgess, "Sigma factors from *E. coli, B. subtilis*, phage SP01, and phage T4 are homologous proteins," Nucleic Acids Res. 14(16):6745-6763 (1986).
Griffin, A. M., and H. G. Griffin, eds., Computer Analysis of Sequence Data, Part I, Humana Press, New Jersey, pp. 1-8 (1994).
Grosschedl et al., "Introduction of a μ immunoglobulin gene into the mouse germ line: specific expression in lymphoid cells and synthesis of functional antibody," Cell 38:647-658 (1984).
Guiotto et al., "An improved procedure for the synthesis of branched polyethylene glycols (PEGs) with the reporter dipeptide Met-betaAla for protein conjugation," Bioorg. Med. Chem. Lett. 12(2):177-180 (2002).
Guo et al., "Neutrophil C5a receptor and the outcome in a rat model of sepsis," FASEB J. 17(13):1889-1891 (2003) 17 pages.
Guo, R. and P. Ward, "Role of C5a in inflammatory responses," Annu. Rev. Immunol. 23:821-852 (2005).
Hack et al., "Elevated plasma levels of the anaphylatoxins C3a and C4a are associated with a fatal outcome in sepsis," Am. J. Med. 86:20-26 (1989).
Hageman et al., "A common haplotype in the complement regulatory gene factor H (HF1/CFH) predisposes individuals to age-related macular degeneration," Proc. Nat. Acad. Sci. 102(20):7227-7232 (2005).
Haines et al., "Complement Factor H Variant Increases the Risk of Age-Related Macular Degeneration," Science 308(5720):419-421 (2005).
Hammer et al., "Diversity of alpha-fetoprotein gene expression in mice is generated by a combination of separate enhancer elements," Science 235:53-58 (1987).
Harahan, "Heritable formation of pancreatic β-cell tumours in transgenic mice expressing recombinant insulin/simian virus 40 oncogenes," Nature 315:115-122 (1985).
Hanto et al., "Intraoperative Administration of Inhaled Carbon Monoxide Reduces Delayed Graft Function in Kidney Allografts in Swine," Am. J. Transplant. 10(11):2421-2430 (2010).

(56) References Cited

OTHER PUBLICATIONS

Harris, J. M. and R. B. Chess, "Effect of pegylation on pharmaceuticals," Nat. Rev. Drug Discov. 2(3):214-221 (2003).
Hartley, B. S., "Enzyme families," Symp. Soc. Gen. Microbiol. 24:151-182 (1974).
Hartman, S. C. and R. C. Mulligan, "Two dominant-acting selectable markers for gene transfer studies in mammalian cells," Proc. Natl. Acad. Sci. USA 85:8047-8051 (1988).
Hecke et al., "Analysis of complement proteins in polytrauma patients-correlation with injury severity, sepsis and outcome," Abstract 291, Shock 7:74 (1997).
Heideman, M. and T. Hugh, "Anaphylatoxin generation in multisystem organ failure," J. Trauma 24(12):1038-1043 (1984).
Herrera-Estrella et al., "Expression of chimaeric genes transferred into plant cells using a ti-plasmid-derived vector," Nature 303:209-213 (1983).
Herrera-Estrella et al., "Light-inducible and chloroplast-associated expression of a chimaeric gene introduced into Nicotiana tabacum using a Ti plasmid vector," Nature 310:115-120 (1984).
Holmskov et al., "Collectins: collagenous C-type lectins of the innate immune defense system," Immunol. Today 15(2):67-74 (1994).
Horizon Scanning Research and Intelligence Centre brief, "Eculizumab (Soliris) for prevention of delayed graft function after kidney transplantation in adult patients at increased risk—first line," Sep. 2016, Retrieved from <URL:io.nihr.ac.uk/wp-content/uploads/migrated/Eculizumab-delayed-graft-function-Sept16.pdf, Retrieved on Jul. 6, 2018, 8 pages.
Huang, X. and W. Miller, "A Time-Efficient, Linear-Space Local Similarity Algorithm," Adv. Appl. Math. 12:337-357 (1991).
IUPAC-IUB Commission on Biochemical Nomenclature, "A one-letter notation for amino acid sequences: tentative rules," J. Biol. Chem. 243(13):3557-3559 (1968).
IUPAC-IUB Commission on Biochemical Nomenclature, "Symbols for amino-acid derivatives and peptides: recommendations (1971)," Biochem. 11(9):1726-1732 (1972).
Jager et al., "Age-Related Macular Degeneration," N. Engl. J. Med. 358:2606-2617 (2008).
Jay et al., "Construction of a general vector for efficient expression of mammalian proteins in bacteria: use of a synthetic ribosome binding site," Proc. Natl. Acad. Sci. U.S.A. 78(9):5543-5548 (1981).
Jha et al., "The Complement System and Ocular Diseases," Mol. Immunol. 44(16):3901-3908 (2007).
Johnson et al., "A Potential Role for Immune Complex Pathogenesis in Drusen Formation," Exp. Eye Res. 70:441-449 (2000).
Johnson et al., "Complement Activation and Inflammatory Processes in Drusen Formation and Age Related Macular Degeneration," Exp. Eye Res. 73:887-896 (2001).
Johnson et al., "The Alzheimer's Aβ-peptide is deposited at sites of complement activation in pathologic deposits associated with aging and age-related macular degeneration," PNAS 99(18):11830-11835 (2002).
Kabouridis, P.S., "Biological applications of protein transduction technology," Trends Biotechnol. 21(11):498-503 (2003).
Kelsey et al., "Species- and tissue-specific expression of human $\alpha_1$-antitrypsin in transgenic mice," Genes Dev. 1:161-171 (1987).
Kendall et al., "Neural Stem Cell Targeting of Glioma Is Dependent on Phosphoinositide 3-Kinase Signaling," Stem Cells 26(6):1575-1586 (2008).
Ketner et al., "Efficient manipulation of the human adenovirus genome as an infectious yeast artificial chromosome clone," Proc. Natl. Acad. Sci. U.S.A. 91:6186-6190. (1994).
Kikić et al., "Clinicopathological relevance of granular C4d deposition in peritubular capillaries of kidney allografts," Transpl. Int 27(3):312-321.
Kim et al., "Cloning and chromosomal mapping of a gene isolated from thymic stromal cells encoding a new mouse type II membrane serine protease, epithin, containing four LDL receptor modules and two CUB domains," Immunogenetics 49:420-428 (1999).
Klein et al., "Complement Factor H Polymorphism in Age-Related Macular Degeneration," Science 308(5720):385-389 (2005).

Kokryakov et al., "Protegrins: leukocyte antimicrobial peptides that combine features of corticostatic defensins and tachyplesins," FEBS Lett. 327(2):231-236 (1993).
Kollias et al., "Regulated expression of human $^A\gamma$-, β-, and hybrid γβ-globin genes in transgenic mice: manipulation of the development expression patterns," Cell 46:89-94 (1986).
Krumlauf et al., "Developmental regulation of α-fetoprotein genes in transgenic mice," Mol. Cell. Biol. 5(7):1639-1648 (1985).
Krupers et al., "Complexation of poly(ethylene oxide) with poly(acrylic acid-co-hydroxyethyl methacrylate)s," Eur. Polym J. 32(6):785-790 (1996).
Lappegard et al., "Differential Effect of Heparin Coating and Complement Inhibition on Artificial Surface-Induced Eicosanoid Production," Ann. Thorac. Surg. 79:917-923 (2005).
Lappegard et al., "The artificial surface-induced whole blood inflammatory reaction revealed by increases in a series of chemokines and growth factors is largely complement dependent," J. Biomed. Mater. Res. A 87(1):129-135 (2008).
Leder et al., "Consequences of widespread deregulation of the c-myc gene in transgenic mice: multiple neoplasms and normal development," Cell 45:485-495 (1986).
Lee et al., "Activation of Hepatocyte Growth Factor and Urokinase/Plasminogen Activator by Matriptase, an Epithelial Membrane Serine Protease," J. Biol. Chem. 275(47):36720-36725 (2000).
Liang et al., "Prediction of antigenic epitopes on protein surfaces by consensus scoring," BMC Bioinformatics 10:302 (2009), 10 pages.
Lin et al., "Inhibition of Nuclear Translocation of Transcription Factor NF-κB by a Synthetic Peptide Containing a Cell Membrane-permeable Motif and Nuclear Localization Sequence," J. Biol. Chem. 270(24):14255-14258 (1995).
Lindenbaum et al., "A mammalian artificial chromosome engineering system (ACE System) applicable to biopharmaceutical protein production, transgenesis and gene-based cell therapy," Nucleic Acids Res. 32(21):e172 (2004).
List et al., "Autosomal Ichthyosis with Hypotrichosis Syndrome Displays Low Matriptase Proteolytic Activity and Is Phenocopied in ST14 Hypomorphic Mice," J. Biol. Chem. 282(50):36714-36723 (2007).
List et al., "Epithelial Integrity Is Maintained by a Matriptase-Dependent Proteolytic Pathway," Am. J. Pathol. 175(4):1453-1463 (2009).
List et al., "Matriptase/MT-SP1 is required for postnatal survival, epidermal barrier function, hair follicle development, and thymic homeostasis," Oncogene 21(23):3765-3779 (2002).
Liu et al., "Human m-ficolin is a secretory protein that activates the lecitin complement pathway," J. Immunol. 175:3150-3156 (2005).
Lowy et al., "Isolation of Transforming DNA: Cloning the Hamster aprt Gene," Cell 22:817-823 (1980).
Lu, Y. and A. M. Felix, "Pegylated Peptides I: Solid-Phase Synthesis of $N^\alpha$-Pegylated Peptides Using Fmoc Strategy," Peptide Res. 6(3):140-146 (1993).
Lu, Y. and A. M. Felix, "Pegylated peptides II. Solid-phase synthesis of amino-, carboxy- and side-chain pegylated peptides," Int. J. Peptide Protein Res. 43:127-138 (1994).
MacDonald, R. J. "Expression of the pancreatic elastase I gene in transgenic mice," Hepatology 7(1):425-515 (1987).
Magram et al., "Developmental regulation of a cloned adult β-globin gene in transgenic mice," Nature 315:338-340 (1985).
Malhotra et al., "Collectins, collectin receptors and the lectin pathway of complement activation," Clin. Exp. Immunol. 97(Suppl 2):4-9 (1994).
Maller et al., "Variation in complement factor 3 is associated with risk of age-related macular degeneration," Nat. Genet. 39(10):1200-1201 (2007).
Malmqvist, M., "BIACORE: an affinity biosensor system for characterization of biomolecular interactions," Biochem. Soc. Trans. 27:335-340 (1999).
Malyszko et al., "Biomarkers of delayed graft function as a form of acute kidney injury in kidney transplantation," Nature Scientific Reports 5:11684 (2015), 9 pages.
Markiewski, M. and J. Lambris, "The Role of Complement in Inflammatory Diseases From Behind the Scenes into the Spotlight," Am. J. Pathol. 171:715-727 (2007).

(56) References Cited

OTHER PUBLICATIONS

Mason et al., "The hypogonadal mouse: reproductive functions restored by gene therapy," Science 234:1372-1378(1986).
McGeer, P. and E. McGreer, "The possible role of complement activation in Alzheimer disease," Trends Mol. Med. 8(11):519-523 (2002).
Mehvar, R., "Modulation of the Pharmacokinetics and Pharmacodynamics of Proteins by Polyethylene Glycol Conjugation," J. Pharm. Pharmaceut. Sci. 3(1):125-136 (2000).
Merrifield, R. B., "Solid Phase Peptide Synthesis. I. The Synthesis of a Tetrapeptide," J. Am. Chem. Soc. 85:2149-2154 (1963).
Miller et al., "Use of Retroviral Vectors for Gene Transfer and Expression," Methods Enzymol. 217: 581-599 (1993).
Miyake et al., "The role of asparagine-linked glycosylation site on the catalytic domain of matriptase in its zymogen activation," Biochim BioPhys Acta 1804(1):156-165 (2010).
Mizuno et al., "Soluble complement receptor type 1 protects rats from lethal shock induced by anti-Crry antibody following lipopolysaccharide priming," Int. Arch. Allergy Immunol 127(1):55-62 (2002).
Molineux, G., "Pegylation: Engineering Improved Biopharmaceuticals for Oncology," Pharmacotherapy 23(8 Pt 2):3S-8S (2003).
Mollnes et al., "Essential role of the C5a receptor in *E coli*-induced oxidative burst and phagocytosis revealed by a novel lepirudin-based human whole blood model of inflammation," Blood 100(5):1869-1877 (2002).
Monfardini et al., "A Branched Monomethoxypoly(ethylene glycol) for Protein Modification," Bioconjugate Chem. 6:62-69 (1995).
Montes et al., "Functional basis of protection against age-related macular degeneration conferred by a common polymorphism in complement factor B," Proc. Nat. Acad. Sci. 106(11):4366-4371 (2009).
Morgan, B. P. and C. L. Harris, "Complement therapeutics; history and current progress," Mol. Immunol. 40:159-170 (2003).
Moxley, G. and S. Ruddy, "Elevated plasma. C3 anaphylatoxin levels in rheumatoid arthritis patients," Arthrit. Rheum. 30(10):1097-1104 (1987).
Mullins et al., "Drusen associated with aging and age-related macular degeneration contain proteins common to extracellular deposits associated with atherosclerosis, elastosis, amyloidosis, and dense deposit disease," FASEB J. 14:835-846 (2000).
Needleman, S. B. and C. D. Wunsch, "A general method applicable to the search for similarities in the amino acid sequence of two proteins," J. Mol. Biol. 48:443-453 (1970).
Nilsson et al., "Compstatin Inhibits Complement and Cellular Activation in Whole Blood in Two Models of Extracorporeal Circulation," Blood 92(5):1661-1667 (1998).
Oberst et al., "Matriptase and HAI-1 Are Expressed by Normal and Malignant Epithelial Cells in Vitro and in Vivo," Am. J. Pathol. 158(4):1301-1311.
Oberst et al., "The activation of matriptase requires its noncatalytic domains, serine protease domain, and its cognate inhibitor," J. Biol. Chem. 278(29):26773-26779 (2003).
Oehlke et al., "Cellular uptake of an α-helical amphipathic model peptide with the potential to deliver polar compounds into the cell interior non-endocytically," Biochim. Biophys. Acta. 1414:127-139 (1998).
Ornitz et al., "Elastase I promoter directs expression of human growth hormone and SV40 T antigen genes to pancreatic acinar cells in transgenic mice," Cold Spring Harbor Symp. Quant. Biol. 50:399-409 (1985).
Ostresh et al., "Peptide libraries: determination of relative reaction rates of protected amino acids in competitive couplings," Biopol. 34:1681-1689.
Paborsky et al., "Mammalian cell transient expression of tissue factor for the production of antigen," Protein Engineering 3:547-553 (1990).
Paul, ed., Fundamental Immunology, 2nd ed., Raven Press, New York, pp. 332-336 (1989).
Pennesi et al., "Animal models of age related macular degeneration," Mol. Aspects Med. 33(4):487-509 (2012).
Petrinec et al., "Insulin-like growth factor-I attenuates delayed graft function in a canine renal autotransplantation model," Surgery 120:221-226 (1996).
Pham et al., "Large-scale transient transfection of serum-free suspension-growing HEK293 EBNA1 cells: peptone additives improve cell growth and transfection efficiency," Biotechnol. Bioeng. 84(3):332-342 (2003).
Piddlesden et al., "Soluble recombinant complement receptor 1 inhibits inflammation and demyelination in antibody-mediated demyelinating experimental allergic encephalomyelitis," J. Immunol. 152(11):5477-5484 (1994).
Pinkert et al., "An albumin enhancer located 10 kb upstream functions along with its promoter to direct efficient, liver-specific expression in transgenic mice," Gene Dev. 1:268-276 (1987).
Pooga et al., "Cell penetration by transportan," FASEB J. 12:67-77 (1998).
Pooga et al., "Cellular translocation of proteins by transportan," FASEB J. 15:1451-1453 (2001).
Pratt et al., "Local synthesis of complement component C3 regulates acute renal transplant rejection," Nat. Med. 8(6):582-587 (2002).
Rawlings, N. D. and A. J. Barrett, "Families of serine peptidases," Meth. Enzymol. 244:19-61 (1994).
Readhead et al., "Expression of a myelin basic protein gene in transgenic shiverer mice: correction of the dysmyelinating phenotype," Cell 48:703-712 (1987).
Reynolds et al., "Plasma Complement Components and Activation Fragments: Associations with Age-Related Macular Degeneration Genotypes and Phenotypes," Invest. Ophthalmol. Vis. Sci. 50(12):5818-5827 (2009).
Rhodes et al., "Transformation of Maize by Electroporation of Embryos," In: Methods in Molecular Biology, vol. 55: Plant Cell Electroporation and Electrofusion Protocols, Nickoloff, J.A., ed., Humana Press, Inc., New Jersey, pp. 121-131 (1995).
Rich, R. L. and D. G. Myszka, "Advances in surface plasmon resonance biosensor analysis," Curr. Opin. Biotechnol. 11:54-61 (2000).
Richardson, J., "The anatomy and taxonomy of protein structure," Adv. Prot. Chem. 34:167-339 (1981).
Ricklin, D. and J. D. Lambris, "Complement-targeted therapeutics," Nat. Biotechnol. 25(11):1265-1275 (2007).
Ricklin, D. and J. D. Lambris, "Compstatin: A Complement Inhibitor on its Way to Clinical Application," Adv. Exp. Med. Biol. 632:273-292 (2008).
Rinder et al., "Blockade of C5a and C5b-9 generation inhibits leukocyte and platelet activation during extracorporeal circulation," J. Clin. Invest. 96:1564-1572 (1995).
Roberts et al., "Chemistry for peptide and protein PEGylation," Adv. Drug Deliv. Rev. 54(4):459-476 (2002).
Rosenberg, R. D. and K. A. Bauer, "New Insights into Hypercoagulable States," Hosp. Prac. 21:131-147 (1986).
Ruben et al., "Structural and Functional Characterization of Human Immunodeficiency Virus tat Protein," J. Virol. 63(1):1-8 (1989).
Sahu, A. and J. D. Lambris, "Structure and biology of complement protein C3, a connecting link between innate and acquired immunity," Immunological Reviews 180:35-48 (2001).
Sato, H., "Enzymatic procedure for site-specific pegylation of proteins," Adv. Drug Deliv. Rev. 54(4):487-504 (2002).
Sawhney et al., "Bioerodible Hydrogels Based on Photopolymerized Poly(ethylene glycol)-co-poly(α-hydroxy acid) Diacrylate Macromere," Macromolecules 26: 581-587 (1993).
Scatchard, G., "The attractions of proteins for small molecules and ions," Aim. N.Y. Acad. Sci. 51:660-672 (1949).
Scharf et al., "Heat Stress Promoters and Transcription Factors," Results Probl. Cell Differ. 20:125-162 (1994).
Schmidt et al., "Inhibitor of complement, Compstatin, prevents polymer-mediated Mac-1 up-regulation of human neutrophils independent of biomaterial type tested," J. Biomed. Mater. Res. A 66:491-499 (2003).
Scholl et al., "Systemic Complement Activation in Age-Related Macular Degeneration," PLoS One 3(7):e2593 (2008), 7 pages.

(56) References Cited

OTHER PUBLICATIONS

Schwartz, R. M. aand M. O. Dayhoff, "Matrices for detecting distant relationships," in Atlas of Protein Seuqence and Structure, National Biomedical Research Foundation, pp. 353-358 (1978).
Shani, M. "Tissue-specific expression of rat myosin light-chain 2 gene in transgenic mice," Nature 314:283-286 (1985).
Smith, T. F. and M. S. Waterman, "Comparison of biosequences," Adv. Appl. Math. 2:482-489 (1981).
Soulika et al., "Inhibition of Heparin/Protamine Complex-Induced Complement Activation by Compstatin in Baboons," Clin. Immunol. 96(3):212-221 (2000).
Stevens et al., "Effects of anti-C5a antibodies on the adult respiratory distress syndrome in septic primates," J. Clin. Invest. 77:1812-1816 (1986).
Stove et al., "Circulating complement proteins in patients with sepsis or systemic inflammatory response syndrome," Clin. Diagn. Lab. Immunol. 3(3):175-183 (1996).
Strassburger et al., "Adaptation of plasminogen activator sequences to known protease structures," FEBS Lett. 157(2):219-223 (1983).
Strohl, W. R., "Fusion Proteins for Half-Life Extension of Biologics as a Strategy to Make Biobetters," BioDrugs 29:215-239 (2015).
Stroud, R. M., "A family of protein-cutting proteins," Sci. Am. 231:74-88 (1974).
Swift et al., "Tissue-specific expression of the rat pancreatic elastase I gene in transgenic mice," Cell 38:639-646 (1984).
Szabo et al., "Loss of Matriptase Suppression Underlies Spint1 Mutation-Associated Ichthyosis and Postnatal Lethality," Am. J. Pathol. 174(6):2015-2022 (2009).
Szalai et al., "The Arthus reaction in rodents: species-specific requirement of complement," J. Immunol. 164:463-468 (2000).
Takeuchi et al., "Cellular localization of membrane-type serine protease 1 and identification of protease-activated receptor-2 and single-chain urokinase-type plasminogen activator as substrates," J. Biol. Chem. 275(34):26333-26342 (2000).
Takeuchi et al., "Reverse biochemistry: use of macromolecular protease inhibitors to dissect complex biological processes and identify a membrane-type serine protease in epithelial cancer and normal tissue," Proc. Natl. Acad. Sci. U.S.A. 96:11054-11061 (1999).
Thakkinstian et al., "Systematic review and meta-analysis of the association between complementary factor H Y402H polymorphisms and age-related macular degeneration," Hum. Mol. Genet. 15(18):2784-2790 (2006).
Tjernberg et al., "Acute Antibody-Mediated Complement Activation Mediates Lysis of Pancreatic Islets Cells and May Cause Tissue Loss in Clinical Islet Transplantation," Transplantation 85:1193-1199 (2008).
Tsubery et al., "Prolonging the Action of Protein and Peptide Drugs by a Novel Approach of Reversible Polyethylene Glycol Modification," J. Biol. Chem. 279(37):38118-38124 (2004).
UniProt Database Accession No. P01024, "CO3_Human," Published on Jul. 21, 1986 [online] [retrieved on Jun. 29, 2018] Retrieved from:<URL:uniprot.org/uniprot/P01024 [19 pages].
Veronese et al., "Branched and Linear Poly(Ethylene Glycol): Influence of the Polymer Structure on Enzymological, Pharmacokinetic, and Immunological Properties of ProteinConjugates," J. Bioactive Compatible Polymers 12:196-207(1997).
Wagner et al., "Nucleotide sequence of the thymidine kinase gene of herpes simplex virus type 1," Proc. Natl. Acad. Sci. U.S.A. 78(3):1441-1445 (1981).
Wang et al., "Anti-C5 monoclonal antibody therapy prevents collagen-induced arthritis and ameliorates established disease," Proc. Natl. Acad. Sci. U.S.A. 92:8955-8959 (1995).
Wang et al., "Amelioration of lupus-like autoimmune disease in NZB/W $F_1$ mice after treatment with a blocking monoclonal antibody specific for complement component C5," Proc. Natl. Acad. Sci. U.S.A. 93:8563-8568 (1996).
Wanga et al., "Two Distinct Isoforms of Matrix Metalloproteinase-2 Are Associated with Human Delayed Kidney Graft Function," PLoS One 10(9):e0136276 (2015).
Watson et al., "Molecular Biology of the Gene," 4th Edition, the Benjamin/Cummings Publ. Co., p. 224 (1987).
Weiner et al., "Liposome-collagen gel matrix: a novel sustained drug delivery system," J. Pharm. Sci. 74(9):922-925 (1985).
Wells, J. A., "Additivity of mutational effects in proteins," Biochem. 29(37):8509-8517 (1990).
Wigler et al., "Transfer of Purified Herpes Virus Thymidine Kinase Gene to Cultured Mouse Cells," Cell 11:223-232 (1977).
Wigler et al., "Transformation of mammalian cells with an amplifiable dominant-acting gene," Proc. Natl. Acad. Sci. USA 77(6):3567-3570 (1980).
Wyman et al., "Design, Synthesis, and Characterization of a Cationic Peptide That Binds to Nucleic Acids and Permeabilizes Bilayers," Biochemistry 36:3008-3017 (1997).
Yamamoto et al., "Identification of a functional promoter in the long terminal repeat of rous sarcoma virus," Cell 22:787-797 (1980).
Yan, X. and Z. Yan, "An overview of St14: A type II transmembrane serine protease," Journal of Science and Applications: BioMedicine 3(2):10-17 (2015).
Yang, X. and X. Yu, "An introduction to epitope prediction methods and software," Rev. Med. Virol. 19:77-96 (2009).
Yates et al., "Complement C3 Variant and the Risk of Age-Related Macular Degeneration," New Engl. J. Med. 357(6):553-561 (2007).
Yu et al., "Targeting Complement Pathways During Cold Ischemia and Reperfusion Prevents Delayed Graft Function," Am. J. Transplant. 16(9):2589-2597 (2016).
Zalipsky, S., "Chemistry to polyethylene glycol conjugates with biologically active molecules," Adv. Drug Del. Rev. 16:157-82 (1995).
Zareparsi et al., "Strong Association of the Y402H Variant in Complement Factor H at 1q32 with Susceptibility to Age-Related Macular Degeneration," Am. J. Hum. Genet. 77(1):149-153 (2005).
Zhao, X. and J. Harris, "Novel Degradable Poly(ethylene glycol) Esters for Drug Delivery," in Poly(ethylene glycol), Chemistry and Biological Applications, ACS Symposium Series 680, Hams, J. and S. Zalipsky, (eds.), pp. 458-472 (1997).
Zilow et al., "Complement activation and the prognostic value of C3a in patients at risk of adult respiratory distress syndrome," Clin. Exp. Immunol 79:151-157 (1990).
Catalyst Biosciences: The Protease Therapeutics Company, "Company Overview Jun. 2014," Published Jun. 2, 2014 [online]; retrieved on Nov. 29, 2016 from: <URL:ir.catalystbiosciences.com/phoenix.zhtml?c=254141&p=irol-newsArticle&ID=2192374, 19 pages.
Catalyst Biosciences, United States Securities and Exchange Commission filing, dated Mar. 9, 2016; Retrieved on Jul. 31, 2018, from: <URL:sec.gov/Archives/edgar/data/1124105/000119312516498295/d117011d10k.htm, 109 pages.
Catalyst Biosciences: Company Overview, Presentation, May 2016 [online]; Retrieved on Jan. 17, 2017, from: <URL:ir.catalystbiosciences.com/phoenix.zhtml?c=254141&p=irol-calendar, 25 pages.
Catalyst Biosciences Presentation, presented at the Jefferies 2016 Complement Therapeutics Summit in New York City, on May 3, 2016, 22 pages.
Catalyst Biosciences Press Release, "Catalyst Biosciences Receives Patent Covering its Hemostasis and Anti-Complement Programs," Published on Jun. 20, 2016 [online]; Retrieved on Jan. 17, 2017, from: <URL:ir.catalystbiosciences.com/phoenix.zhtml?c=254141&p=irol-newsArticle&ID=2178726, 2 pages.
Catalyst Biosciences Presentation, "Anti-Complement (C3) for Dry AMD OIS@ASRS," Presented at the Opthalmology Innovation Summit meeting, at the American Society of Retina Specialists on Aug. 8, 2016, San Francisco, CA, 8 pages.
Catalyst Biosciences, "Anti-Complement (C3) for Dry AMD," Presented on Dec. 13, 2016, 21 pages.
Catalyst Biosciences, United States Securities and Exchange Commission filing, dated Mar. 8, 2017; Retrieved on Jul. 31, 2018, from: <URL:sec.gov/Archives/edgar/data/1124105/000156459017003722/cbio-10k_20161231.htm, 122 pages.
Catalyst Biosciences Press Release, "Catalyst Biosciences and Mosaic Biosciences Enter into Strategic Collaboration to Develop Intravitreal Anti-Complement Factor 3 (C3) Products for the Treatment of Dry AMD and Other Retinal Diseases," published Oct. 24,

(56) References Cited

OTHER PUBLICATIONS

2017 [online]; retrieved on Jan. 30, 2018 from: <URL:ir.catalystbiosciences.com/phoenix.zhtml?c=254141&p=irol-newsArticle_print&ID=2310657, 3 pages.
Catalyst Biosciences Presentation, "Catalyst Biosciences: Essential Medicines for Hemophilia; Greater Convenience; Superior Outcomes," presented at the BIO CEO Conference on Feb. 12, 2018, 21 pages.
Catalyst Biosciences, United States Securities and Exchange Commission filing, dated Mar. 19, 2018; Retrieved on Jul. 30, 2018, from: <URL:getfilings.com/sec-filings/180319/CATALYST-BIOSCIENCES-INC_10-K/, 132 pages.
Furfine et al., Catalyst Biosciences Presentation, "Discovery and Planned Optimization of a Complement Factor C3-Inactivating Alterase, CB-2782," Poster No. 60-A0107, Session 105: AMD and Retinal Therapies Excluding Anti-VEGF. Presented at the 2018 Association for Research in Vision and Ophthalmology (ARVO) Annual Meeting, Honolulu, Hawaii, on Apr. 29, 2018, 1 page.
Usman, N., Catalyst Biosciences Presentation, "Catalyst Biosciences: Essential Medicines for Hemophilia; Greater Convenience; Superior Outcomes," presented at the JMP Securities 2018 Life Sciences Conference, New York, USA, on Jun. 21, 2018, 23 pages.
Letter/Written Disclosure of the Supplemental Information Disclosure Statement for the above-referenced application, filed herewith on Dec. 20, 2018, 2 pages.
Usman, N., Catalyst Biosciences Investor Presentation, presented at the H.C. Wainwright & Co. 20$^{TH}$Annual Global Investment Conference, New York, USA, on Sep. 5, 2018, 25 pages.
Usman, N., Catalyst Biosciences Investor Presentation, presented at the 2018 Cantor Fitzgerald Global Healthcare Conference, New York, USA, on Oct. 1, 2018, and the Ladenburg Thalmann 4$^{th}$ Annual Healthcare Conference, New York, USA, on Oct. 2, 2018, 25 pages.
Darragh et al., "MT-SP1 proteolysis and regulation of cell-microenvironment interactions," Frontiers in Bioscience 13:528-539 (2008).
"Human MT-SP1 protease mutant, SEQ: 698," XP-002784373, dated Oct. 9, 2014; retrieved from EBI accession No. GSP:BBM48204; Database accession No. BBM48204, 1 page.
"Human MT-SP1 protease mutant, SEQ: 591," XP-002784374, dated Oct. 9, 2014; retrieved from EBI accession No. GSP:BBM48097; Database accession No. BBM48097, 1 page.
"Human MT-SP1 protease mutant, SEQ: 48," XP-002784375, dated Oct. 9, 2014; retrieved from EBI accession No. GSP:BBM47554; Database accession No. BBM47554, 1 page.
"Human MT-SP1 protease mutant, SEQ: 527," XP-002784376, dated Oct. 9, 2014; retrieved from EBI accession No. GSP:BBM48033; Database accession No. BBM48033, 1 page.
"Human MT-SP1 protease mutant, SEQ: 67," XP-002784377, dated Oct. 9, 2014; retrieved from EBI accession No. GSP:BBM47573; Database accession No. BBM47573, 1 page.
"Mutant MTSP1 protease domain, SEQ ID 584," XP-002784378, dated Nov. 13, 2008; retrieved from EBI accession No. GSP:ARQ04394; Database accession No. ARQ04394, 2 pages.
"Mutant MTSP1 protease domain, SEQ ID 572," XP-002784379, dated Nov. 13, 2008; retrieved from EBI accession No. GSP:ARQ04382; Database accession No. ARQ04382, 2 pages.
International Search Report and Written Opinion, dated Dec. 10, 2018, in connection with International Patent Application No. PCT/US2018/038844, 26 pages.

| SEQ ID NO: | Mutation by Chymotrypsin Numbering ||||||||||||| hC3 cleavage (ED$_{50}$, nM) | MTSP-1 Polypeptide Stability (% Activity) on Day 7 ||
| | Q38 | I41 | D60b | F60e | Y60g | D96 | F97 | Ins 97a | T98 | F99 | G151 | Q175 | Q192 | | Vitreous | PBS |
|---|---|---|---|---|---|---|---|---|---|---|---|---|---|---|---|---|
| 4 | Q | I | D | F | Y | D | F | | T | F | G | Q | Q | 13.6 | 59 | 63 |
| 35 | H | S | T | S | W | K | G | V | P | L | H | L | D | 4.6 | 92 | 94 |
| 47 | Q | S | T | S | W | K | G | V | P | L | H | L | D | 17 | 86 | 87 |
| 48 | H | I | T | S | W | K | G | V | P | L | H | L | D | 205 | 76 | 78 |
| 49 | H | S | D | S | W | K | G | V | P | L | H | L | D | 13 | 87 | 81 |
| 50 | H | S | T | F | W | K | G | V | P | L | H | L | D | 8.7 | 85 | 91 |
| 51 | H | S | T | S | Y | K | G | V | P | L | H | L | D | 22 | 85 | 93 |
| 38 | H | S | T | S | W | D | G | V | P | L | H | L | D | 11.9 | 73 | 91 |
| 39 | H | S | T | S | W | K | F | V | P | L | H | L | D | 20 | 77 | 85 |
| 52 | H | S | T | S | W | K | G | | P | L | H | L | D | 7.9 | 19 | 34 |
| 53 | H | S | T | S | W | K | G | V | T | L | H | L | D | 9.9 | 66 | 82 |
| 54 | H | S | T | S | W | K | G | V | P | F | H | L | D | 18 | 94 | 98 |
| 55 | H | S | T | S | W | K | G | V | P | L | G | L | D | 5.3 | 74 | 87 |
| 56 | H | S | T | S | W | K | G | V | P | L | H | Q | D | 20 | 90 | 94 |
| 40 | H | S | T | S | W | K | G | V | P | L | H | L | Q | 1.6 | 18 | 23 |

FIGURE 2

MODIFIED MEMBRANE TYPE SERINE PROTEASE 1 (MTSP-1) POLYPEPTIDES AND METHODS OF USE

RELATED APPLICATIONS

Benefit of priority is claimed to U.S. provisional application Ser. No. 62/523,735, filed Jun. 22, 2017, to Madison, Edwin L., Soros, Vanessa, and Popkov, Mikhail, entitled "MODIFIED MEMBRANE TYPE SERINE PROTEASE 1 (MT-SP1) POLYPEPTIDES AND METHODS OF USE." Benefit of priority also is claimed to U.S. provisional application Ser. No. 62/664,051, filed Apr. 27, 2018, to Madison, Edwin L., Soros, Vanessa, and Popkov, Mikhail, entitled "MODIFIED MEMBRANE TYPE SERINE PROTEASE 1 (MTSP-1) POLYPEPTIDES AND METHODS OF USE." Where permitted, the subject matter of each of these applications is incorporated by reference in its entirety.

This application is related to International Patent Application Serial No. PCT/US2018/038844, filed the same day herewith, entitled "MODIFIED MEMBRANE TYPE SERINE PROTEASE 1 (MTSP-1) POLYPEPTIDES AND METHODS OF USE," which claims priority to U.S. Provisional Application No. 62/523,735 and U.S. Provisional Application No. 62/664,051.

INCORPORATION BY REFERENCE OF SEQUENCE LISTING PROVIDED ELECTRONICALLY

An electronic version of the Sequence Listing is filed herewith, the contents of which are incorporated by reference in their entirety. The electronic file was created on Jun. 18, 2018, is 1.4 megabytes in size, and is titled 4939SEQ001.txt. A substitute Sequence Listing is filed electronically herewith, the contents of which are incorporated by reference in their entirety. The electronic file was created on Jul. 13, 2018, is 1.4 megabytes in size, and is titled 4939SEQ002.txt. A substitute Sequence Listing is filed electronically herewith, the contents of which are incorporated by reference in their entirety. The electronic file was created on Jul. 23, 2018, is 1.4 megabytes in size, and is titled 4939SEQ003.txt. A substitute Sequence Listing is filed electronically herewith, the contents of which are incorporated by reference in their entirety. The electronic file was created on Mar. 30, 2020, is 1.4 megabytes in size, and is titled 4939SE0004.txt.

FIELD OF THE INVENTION

Provided are modified MTSP-1 polypeptides that cleave a complement protein, thereby, inhibiting complement activation. By virtue of this inhibition the modified MTSP-1 polypeptides can be used for treatment diseases and conditions mediated by complement or in which complement activation plays role. These disease and conditions, include, but are not limited to, ophthalmic indications, including macular degeneration, such as age-related macular degeneration (AMD), diabetic retinopathies, and Stargardt disease, renal delayed graft function (DGF), ischemic and reperfusion disorders, including myocardial infarction and stroke, sepsis, autoimmune diseases, inflammatory diseases and diseases with an inflammatory component, including Alzheimer's Disease and other neurodegenerative disorders.

BACKGROUND

The complement (C) system is part of the immune system and plays a role in eliminating invading pathogens and in initiating the inflammatory response. The complement system of humans and other mammals involves more than 30 soluble and membrane-bound proteins that participate in an orderly sequence of reactions resulting in complement activation. The blood complement system has a wide array of functions associated with a broad spectrum of host defense mechanisms including anti-microbial and anti-viral actions. Products derived from the activation of C components include the non-self-recognition molecules C3b, C4b and C5b, as well as the anaphylatoxins C3a, C4a and C5a that influence a variety of cellular immune responses. These anaphylatoxins also act as pro-inflammatory agents.

The complement system is composed of an array of enzymes and non-enzymatic proteins and receptors. Complement activation occurs by one of three primary modes known as the "classical" pathway, the "alternative" pathway and the "lectin" pathway (see FIG. 1). Complement typically is activated or triggered by 1 of these 3 pathways, which as shown in FIG. 1, converge at C3 activation. In a fourth complement-activation mechanism, referred to as the intrinsic pathway, serine proteases associated with the coagulation/fibrinolytic cascade activate the complement system directly through cleavage of C3 or C5, independently of the classical, alternate, and lectin pathways. These pathways can be distinguished by the process that initiates complement activation. The classical pathway is initiated by antibody-antigen complexes or aggregated forms of immunoglobulins; the alternative pathway is initiated by the recognition of structures on microbial and cell surfaces; and the lectin pathway, which is an antibody-independent pathway, is initiated by the binding of mannan binding lectin (MBL, also designated mannose binding protein) to carbohydrates such as those that are displayed on the surface of bacteria or viruses. Activation of the cascades results in production of complexes involved in proteolysis or cell lysis and peptides involved in opsonization, anaphylaxis and chemotaxis.

The complement cascade, which is a central component of an animal's immune response, is an irreversible cascade. Numerous protein cofactors regulate the process. Inappropriate regulation, typically inappropriate activation, of the process can be a facet of or can occur in a variety of disorders that involve inappropriate inflammatory and immune responses, such as those observed in acute and chronic inflammatory diseases and other conditions involving an inappropriate immune response. These diseases and disorders include autoimmune diseases, such as rheumatoid arthritis and lupus, cardiac disorders and other inflammatory diseases, such as sepsis and ischemia-reperfusion injury.

Because of the involvement of the complement pathways in a variety of diseases and conditions, components of the complement pathways are targets for therapeutic intervention, particularly for inhibition of the pathway. Examples of such therapeutics include synthetic and natural small molecule therapeutics, antibody inhibitors, and recombinant soluble forms of membrane complement regulators. There are limitations to strategies for preparing such therapeutics. Small molecules have short half-lives in vivo and need to be continually infused to maintain complement inhibition thereby limiting their role, especially in chronic diseases. Therapeutic antibodies can result in an immune response in a subject, and thus can lead to complications in treatment, particularly treatments designed to modulate immune responses. Thus, there exists a need for therapeutics for treatment of complement-mediated diseases and diseases in which complement activation plays a role. These include acute and chronic inflammatory diseases. Accordingly, among the objectives herein, it is an objective to provide such therapeutics to target the activation of the complement cascade and to provide therapeutics and methods of treatment of diseases.

SUMMARY

Modified MTSP-1 polypeptides, comprising one or more of amino acid modifications I41S, Q38H, D60bT, F60eS or R, Y60gW, ins97aV, D96K, F97G, G151H or N and Q192T, whereby the modified MTSP-1 polypeptide has increased activity and/or specificity for a complement protein compared to the unmodified active form of the MTSP-1 polypeptide, where the amino acid modifications are selected from among replacements, insertions and deletions in the primary amino acid sequence of the unmodified MTSP-1 polypeptide; the modified MTSP-1 polypeptide cleaves a complement protein to thereby inhibit or reduce complement activation compared to an active form of the unmodified MTSP-1 polypeptide that does not contain the amino acid modification(s); residues are numbered by chymotrypsin numbering; corresponding residues are determined by alignment and chymotrypsin numbering; the unmodified MTSP-1 polypeptide comprises the sequence of amino acids set forth in any of SEQ ID NOs.:1-4 (wild-type full-length MTSP-1, wild-type protease domain MTSP-1, wild-type mature MTSP-1, full-length MTSP-1 with C122S, protease domain MTSP-1 with C122S, mature MTSP-1 with C122S) or a catalytically active fragment or form thereof that includes the amino acid modification(s). Modifications are in the primary sequence, and include insertions, replacements and deletions. The modified MTSP-1 polypeptides include modifications that improve or alter activity, and other properties, including properties that improve their use as pharmaceuticals. For example, the modified MTSP-1 polypeptides can be conjugated to moieties that increase stability, serum half-life, shelf-life and other such properties. These modifications include conjugation to polymers, such as PEGylation moieties, other polypeptides for targeting, identifying and purifying, to the modified MTPS-1.

The complement protein for which modified MTSP-1 polypeptides provided herein are modified to inactivate is C3, such that the modified MTSP-1 polypeptides cleave a site that inactivates C3. By virtue of inactivation of C3, complement activation is reduced or inhibited. By virtue of inhibition or reduction of complement activation, any disease, condition or disorder in which complement plays a role or in which a reduction of complement activation can treat or reduce symptoms or pathology of the disease or disorder, can be treated with the modified MTSP-1 polypeptides provided herein. Target sites in C3 for inactivation cleavage include residues 737-744; cleavage within these residues, such as between residues 740 and 741 of SEQ ID NO:9 (Q H A R↓A S H L), inactivates C3. Activity/specificity for the cleavage of C3 can be increased compared to an active form of the unmodified MTSP-1 polypeptide that does not contain the amino acid modification(s). The modified MTSP-1 polypeptides provided herein are designed to have increased activity for cleavage of C3 that is least 1-fold greater or more than 1-fold greater than an active form, such as the full length or protease domain, of the unmodified MTSP-1 polypeptide of SEQ ID NO:4 (the protease domain with the free cysteine, C122 by chymotrypsin numbering, replaced by S). Cleavage activity for inactivating C3 can be increased by any amount, such as at least 0.5-fold, 1-fold, 1.2 fold, 1.5-fold, 2-, 3-4-, 5-, 6-, 7-, 8-, 9-, 10-fold or more than the unmodified modified MTSP-1 polypeptide of SEQ ID NO: 4. The unmodified MTSP-1 polypeptide is selected from among polypeptides of SEQ ID NOs.: 1-4 and catalytically active portions thereof.

The modified MTSP-1 polypeptide, which includes at least one modification, such I41S, Q38H, D60bT, F60eS or R, Y60gW, ins97aV, D96K, F97G, G151H or N and Q192T, or combinations of these or other replacements as described herein, has at least 85%, 86%, 87%, 88%, 89%, 90%, 91%, 92%, 93%, 94%, 95%, 96%, 97%, 98%, 99% or more sequence identity with the polypeptides of any of SEQ ID NOs.: 1-4. The modified MTSP-1 polypeptide can have at least 1, 2, 3, 4, 5, 6, 7, 8, 9, 10, 11, 12, 13, 14, 15, 16, 17, 18 19, 20, 21, 22, 23, 24 or 25 modifications, including insertions, deletions and replacements in the primary sequence in the polypeptides of any of SEQ ID NOs:1-4 and catalytically active portions thereof.

For example, provided are modified MTSP-1 polypeptides that comprise a modification corresponding to any one or more of I41S, Q38H, D60bT, F60eS, oY60gW, ins97aV, D96K, F97G, G151H, G151N, Q192T, Q192D and/or Q192E. The modified MTSP-1 polypeptides further can include additional replacements corresponding to and selected from one or more of F60eR, Y59F, F99L, T98P, Q175L or selected from one or more modifications at a position corresponding to D217, such as D217V, I, L, W or M, I41D, E, T, G or R. As above, corresponding positions are determined by chymotrypsin numbering. Exemplary modified MTSP-1 polypeptides include modified MTSP-1 polypeptides that contain I41E/F99L/C122S/G151N/Q192T; I41D/C122S/G151N/Q192T; I41S/F99L/C122S/G151N/Q192V; or I41E/F99L/C122S/G151N/Q192T or the same modifications except C122S is C122C. Other exemplary modified MTSP-1 polypeptide include modifications corresponding to any of:
I41R/F97T/Ins97aE/T98G/F99L/C122S/G151N/Q175L/Q192E or I41R/F97T/Ins97aE/T98G/F99L/C122S/G151N/Q175L/Q192D, I41D/Y59F/D96E/F99L/C122S/G151N/Q192T or I41D/Y59F/C122S/G151N/Q192T.

Also provided are modified MTSP-1 polypeptides that include modifications corresponding to any of:
I41R/F97T/Ins97aE/T98G/F99L/C122S/G151N/Q175L/Q192E, or Q38H/I41A/D60bV/F60eR/Y60gW/F97T/ins97aE/T98G/F99L/C122S/G151N/Q175 L/Q192D, or Q38H/I41A/D60bT/F60eK/Y60gW/F97T/ins97aE/T98G/F99L/C122S/G151N/Q175 L/Q192D, or Q38H/I41S/D60bT/F60eS/Y60gW/F97D/ins97aV/T98P/F99L/C122S/G151H/Q175L/Q192E, or Q38H/I41S/D60bT/F60eS/Y60gW/F97D/ins97aV/T98P/F99L/C122S/G151H/Q175L/Q192D, or Q38H/I41A/D60bT/F60eK/Y60gW/F97T/ins97aE/T98G/F99L/C122S/G151N/Q175 L/Q192D, or Q38H/I41S/D60bT/F60eS/Y60gW/F97D/ins97aV/T98P/F99L/C122S/G151N/Q175L/Q192D, or Q38H/I41A/D60bV/F60eR/Y60gW/F97T/ins97aE/T98G/F99L/C122S/G151H/Q175 L/Q192D, or Q38H/I41A/D60bV/F60eR/Y60gW/D96I/F97Y/ins97aN/T98G/F99L/C122S/G151N/Q175L/Q192D, or Q38H/I41S/D60bT/F60eS/Y60gW/D96K/F97D/ins97aA/T98P/F99L/C122S/G151H/Q175L/Q192D, or Q38H/I41A/D60bV/F60eR/Y60gW/D96P/F97W/ins97aN/T98G/F99L/C122S/G151N/Q175L/Q192E, or Q38H/I41A/D60bV/F60eR/Y60gW/D96I/F97N/T98G/F99L/C122S/G151N/Q175L/Q192D, or Q38H/I41S/D60bT/F60eS/Y60gW/D96Y/F97E/ins97aV/T98G/F99L/C122S/G151H/Q175L/Q192D, or Q38H/I41S/D60bT/F60eS/Y60gW/D96L/F97D/ins97aG/T98N/F99L/C122S/G151H/Q175L/Q192E, or Q38H/I41S/D60bT/F60eS/Y60gW/D96K/F97G/ins97aV/T98P/F99L/C122S/G151H/Q175L/Q192D, or Q38H/I41S/D60bT/F60eS/Y60gW/

D96V/F97G/ins97aV/T98P/F99L/C122S/G151H/Q175L/Q192D, or Q38H/I41S/D60bT/F60eS/Y60gW/D96K/F97D/ins97aA/T98P/F99L/C122S/G151N/Q175L/Q192D, or Q38H/I41S/D60bT/F60eS/Y60gW/F97G/ins97aV/T98P/F99L/C122S/G151H/Q175L/Q192D, or Q38H/I41S/D60bT/F60eS/Y60gW/D96K/ins97aV/T98P/F99L/C122S/G151H/Q175L/Q192D, or Q38H/I41S/D60bT/F60eS/Y60gW/D96K/F97G/ins97aV/T98P/F99L/C122S/G151H/Q175L, or I41E/F99L/C122S/G151N/Q192T, or I41D/C122S/G151N/Q192T, or I41S/F99L/C122S/G151N/Q192V, or I41E/F99L/C122S/G151N/Q192T, or I41D/Y59F/D96E/F99L/C122S/G151N/Q192T, or I41D/Y59F/C122S/G151N/Q192T, or I41S/D60bT/F60eS/Y60gW/D96K/F97G/ins97aV/T98P/F99L/C122S/G151H/Q175L/Q192D, or Q38H/D60bT/F60eS/Y60gW/D96K/F97G/ins97aV/T98P/F99L/C122S/G151H/Q175 L/Q192D, or Q38H/I41S/F60eS/Y60gW/D96K/F97G/ins97aV/T98P/F99L/C122S/G151H/Q175L/Q192D, or Q38H/I41S/D60bT/Y60gW/D96K/F97G/ins97aV/T98P/F99L/C122S/G151H/Q175L/Q192D, or Q38H/I41S/D60bT/F60eS/D96K/F97G/ins97aV/T98P/F99L/C122S/G151H/Q175L/Q192D, or Q38H/I41S/D60bT/F60eS/Y60gW/D96K/F97G/T98P/F99L/C122S/G151H/Q175L/Q 192D, or Q38H/I41S/D60bT/F60eS/Y60gW/D96K/F97G/ins97aV/F99L/C122S/G151H/Q175 L/Q192D, or Q38H/I41S/D60bT/F60eS/Y60gW/D96K/F97G/ins97aV/T98P/C122S/G151H/Q175 L/Q192D, or Q38H/I41S/D60bT/F60eS/Y60gW/D96K/F97G/ins97aV/T98P/F99L/C122S/Q175L/Q192D, or Q38H/I41S/D60bT/F60eS/Y60gW/D96K/F97G/ins97aV/T98P/F99L/C122S/G151H/Q192D, or Q38H/I41S/D96K/F97G/ins97aV/T98P/F99L/C122S/Q192D, or I41S/D96K/F97G/ins97aV/T98P/F99L/C122S/Q175L/Q192D, or I41S/D96K/F97G/ins97aV/T98P/F99L/C122S/Q192D, or Q38H/I41S/D96K/F97G/ins97aV/T98P/F99L/C122S/Q175L/Q192D, or Q38H/I41S/D60bY/D96K/F97G/ins97aV/T98P/F99L/C122S/Q192D/D217V, or I41S/D96K/F97G/ins97aV/T98P/F99L/C122S/Q192G/D217V, or I41S/D60bY/D96K/F97G/ins97aV/T98P/F99L/C122S/Q192D/D217V, or I41S/D96M/F97G/ins97aV/T98P/F99L/C122S/Q192G/D217V, or I41S/D96K/F97G/ins97aV/T98P/F99L/C122S/Q192V/D217I, or I41S/D96K/F97G/ins97aV/T98P/F99L/C122S/Q192H, or I41S/D96K/F97G/ins97aV/T98P/F99L/C122S/Q192N/D217V, or I41S/D60bY/D96K/F97G/ins97aV/T98P/F99L/C122S/Q175L/Q192D, or Q38H/I41S/D96K/F97G/ins97aV/T98P/F99L/C122S/Q192G/D217V, or I41S/D96K/F97G/ins97aV/T98P/F99L/C122S/Q175L/Q192V, or I41S/P49S/D96K/F97G/ins97aV/T98P/F99L/C122S/Q192G/D217V, or I41S/D96K/F97G/ins97aV/T98P/F99L/C122S/Q175L/Q192N/I217V, or I41T/F97W/F99L/C122S/G151N/Q175M/Q192G/D217L, or I41G/F97L/F99L/C122S/Q175A/Q192T/D217V, or I41G/F97V/F99L/C122S/G151Q/Q175M/Q192A/D217L, or I41G/F97I/F99L/C122S/G151L/Q175M/Q192S/D217V, or I41G/F97S/F99L/C122S/G151N/Q175L/Q192G/D217I, or I41T/F97L/F99L/C122S/G151N/Q175S/Q192S/D217W, or I41D/F97T/F99M/C122S/Q192V/D217M, or the same modifications except C122S is not modified and is C122C.

Also provided are modified MTSP-1 polypeptides that include modifications selected from among combinations that include one or more of modifications Q38H, I41S, D60bT, F60eS, Y60gW, D96K, F97G, Ins97aV and G151H as follows: G151H, Ins97aV, Ins97aV/G151H, F97G, F97G/G151H, F97G/Ins97aV, F97G/Ins97aV/G151H, D96K, D96K/G151H, D96K/Ins97aV, D96K/Ins97aV/G151H, D96K/F97G, D96K/F97G/G151H, D96K/F97G/Ins97aV, D96K/F97G/Ins97aV/G151H, Y60gW, Y60gW/G151H, Y60gW/Ins97aV, Y60gW/Ins97aV/G151H, Y60gW/F97G, Y60gW/F97G/G151H, Y60gW/F97G/Ins97aV, Y60gW/F97G/Ins97aV/G151H, Y60gW/D96K, Y60gW/D96K/G151H, Y60gW/D96K/Ins97aV, Y60gW/D96K/Ins97aV/G151H, Y60gW/D96K/F97G, Y60gW/D96K/F97G/G151H, Y60gW/D96K/F97G/Ins97aV, Y60gW/D96K/F97G/Ins97aV/G151H, F60eS, F60eS/G151H, F60eS/Ins97aV, F60eS/Ins97aV/G151H, F60eS/F97G, F60eS/F97G/G151H, F60eS/F97G/Ins97aV, F60eS/F97G/Ins97aV/G151H, F60eS/D96K, F60eS/D96K/G151H, F60eS/D96K/Ins97aV, F60eS/D96K/Ins97aV/G151H, F60eS/D96K/F97G, F60eS/D96K/F97G/G151H, F60eS/D96K/F97G/Ins97aV, F60eS/D96K/F97G/Ins97aV/G151H, F60eS/Y60gW, F60eS/Y60gW/G151H, F60eS/Y60gW/Ins97aV, F60eS/Y60gW/Ins97aV/G151H, F60eS/Y60gW/F97G, F60eS/Y60gW/F97G/G151H, F60eS/Y60gW/F97G/Ins97aV, F60eS/Y60gW/F97G/Ins97aV/G151H, F60eS/Y60gW/D96K, F60eS/Y60gW/D96K/G151H, F60eS/Y60gW/D96K/Ins97aV, F60eS/Y60gW/D96K/Ins97aV/G151H, F60eS/Y60gW/D96K/F97G, F60eS/Y60gW/D96K/F97G/G151H, F60eS/Y60gW/D96K/F97G/Ins97aV, F60eS/Y60gW/D96K/F97G/Ins97aV/G151H, D60bT, D60bT/G151H, D60bT/Ins97aV, D60bT/Ins97aV/G151H, D60bT/F97G, D60bT/F97G/G151H, D60bT/F97G/Ins97aV, D60bT/F97G/Ins97aV/G151H, D60bT/D96K, D60bT/D96K/G151H, D60bT/D96K/Ins97aV, D60bT/D96K/Ins97aV/G151H, D60bT/D96K/F97G, D60bT/D96K/F97G/G151H, D60bT/D96K/F97G/Ins97aV, D60bT/D96K/F97G/Ins97aV/G151H, D60bT/Y60gW, D60bT/Y60gW/G151H, D60bT/Y60gW/Ins97aV, D60bT/Y60gW/Ins97aV/G151H, D60bT/Y60gW/F97G, D60bT/Y60gW/F97G/G151H, D60bT/Y60gW/F97G/Ins97aV, D60bT/Y60gW/F97G/Ins97aV/G151H, D60bT/Y60gW/D96K, D60bT/Y60gW/D96K/G151H, D60bT/Y60gW/D96K/Ins97aV, D60bT/Y60gW/D96K/Ins97aV/G151H, D60bT/Y60gW/D96K/F97G, D60bT/Y60gW/D96K/F97G/G151H, D60bT/Y60gW/D96K/F97G/Ins97aV, D60bT/Y60gW/D96K/F97G/Ins97aV/G151H, D60bT/F60eS, D60bT/F60eS/G151H, D60bT/F60eS/Ins97aV, D60bT/F60eS/Ins97aV/G151H, D60bT/F60eS/F97G, D60bT/F60eS/F97G/G151H, D60bT/F60eS/F97G/Ins97aV, D60bT/F60eS/F97G/Ins97aV/G151H, D60bT/F60eS/D96K, D60bT/F60eS/D96K/G151H, D60bT/F60eS/D96K/Ins97aV, D60bT/F60eS/D96K/Ins97aV/G151H, D60bT/F60eS/D96K/F97G, D60bT/F60eS/D96K/F97G/G151H, D60bT/F60eS/D96K/F97G/Ins97aV, D60bT/F60eS/D96K/F97G/Ins97aV/G151H, D60bT/F60eS/Y60gW, D60bT/F60eS/Y60gW/G151H, D60bT/F60eS/Y60gW/Ins97aV, D60bT/F60eS/Y60gW/Ins97aV/G151H, D60bT/F60eS/Y60gW/F97G, D60bT/F60eS/Y60gW/F97G/G151H, D60bT/F60eS/Y60gW/F97G/Ins97aV, D60bT/F60eS/Y60gW/F97G/Ins97aV/G151H, D60bT/F60eS/Y60gW/D96K, D60bT/F60eS/Y60gW/D96K/G151H, D60bT/F60eS/Y60gW/D96K/Ins97aV, D60bT/F60eS/Y60gW/D96K/Ins97aV/G151H, D60bT/F60eS/Y60gW/D96K/F97G, D60bT/F60eS/Y60gW/D96K/F97G/G151H, D60bT/F60eS/Y60gW/D96K/F97G/Ins97aV, D60bT/F60eS/Y60gW/D96K/F97G/Ins97aV/G151H, I41S, I41S/G151H, I41S/Ins97aV, I41S/Ins97aV/G151H, I41S/F97G, I41S/F97G/G151H, I41S/F97G/Ins97aV, I41S/F97G/Ins97aV/G151H, I41S/D96K, I41S/D96K/G151H, I41S/D96K/Ins97aV, I41S/D96K/Ins97aV/G151H, I41S/D96K/F97G, I41S/D96K/F97G/G151H, I41S/D96K/F97G/Ins97aV, I41S/D96K/F97G/Ins97aV/G151H, I41S/Y60gW, I41S/Y60gW/G151H, I41S/Y60gW/Ins97aV, I41S/Y60gW/Ins97aV/G151H, I41S/Y60gW/F97G, I41S/Y60gW/F97G/G151H, I41S/Y60gW/F97G/Ins97aV, I41S/Y60gW/F97G/Ins97aV/G151H, I41S/Y60gW/D96K, I41S/Y60gW/D96K/

G151H, I41S/Y60gW/D96K/Ins97aV, I41S/Y60gW/D96K/ Ins97aV/G151H, I41S/Y60gW/D96K/F97G, I41S/Y60gW/ D96K/F97G/G151H, I41S/Y60gW/D96K/F97G/Ins97aV, I41S/Y60gW/D96K/F97G/Ins97aV/G151H, I41S/F60eS, I41S/F60eS/G151H, I41S/F60eS/Ins97aV, I41S/F60eS/ Ins97aV/G151H, I41S/F60eS/F97G, I41S/F60eS/F97G/ G151H, I41S/F60eS/F97G/Ins97aV, I41S/F60eS/F97G/ Ins97aV/G151H, I41S/F60eS/D96K, I41S/F60eS/D96K/ G151H, I41S/F60eS/D96K/Ins97aV, I41S/F60eS/D96K/ Ins97aV/G151H, I41S/F60eS/D96K/F97G, I41S/F60eS/ D96K/F97G/G151H, I41S/F60eS/D96K/F97G/Ins97aV, I41S/F60eS/D96K/F97G/Ins97aV/G151H, I41S/F60eS/ Y60gW, I41S/F60eS/Y60gW/G151H, I41S/F60eS/Y60gW/ Ins97aV, I41S/F60eS/Y60gW/Ins97aV/G151H, I41S/ F60eS/Y60gW/F97G, I41S/F60eS/Y60gW/F97G/G151H, I41S/F60eS/Y60gW/F97G/Ins97aV, I41S/F60eS/Y60gW/ F97G/Ins97aV/G151H, I41S/F60eS/Y60gW/D96K, I41S/ F60eS/Y60gW/D96K/G151H, I41S/F60eS/Y60gW/D96K/ Ins97aV, I41S/F60eS/Y60gW/D96K/Ins97aV/G151H, I41S/F60eS/Y60gW/D96K/F97G, I41S/F60eS/Y60gW/ D96K/F97G/G151H, I41S/F60eS/Y60gW/D96K/F97G/ Ins97aV, I41S/F60eS/Y60gW/D96K/F97G/Ins97aV/ G151H, I41S/D60bT, I41S/D60bT/G151H, I41S/D60bT/ Ins97aV, I41S/D60bT/Ins97aV/G151H, I41S/D60bT/F97G, I41S/D60bT/F97G/G151H, I41S/D60bT/F97G/Ins97aV, I41S/D60bT/F97G/Ins97aV/G151H, I41S/D60bT/D96K, I41S/D60bT/D96K/G151H, I41S/D60bT/D96K/Ins97aV, I41S/D60bT/D96K/Ins97aV/G151H, I41S/D60bT/D96K/ F97G, I41S/D60bT/D96K/F97G/G151H, I41S/D60bT/ D96K/F97G/Ins97aV, I41S/D60bT/D96K/F97G/Ins97aV/ G151H, I41S/D60bT/Y60gW, I41S/D60bT/Y60gW/ G151H, I41S/D60bT/Y60gW/Ins97aV, I41S/D60bT/ Y60gW/Ins97aV/G151H, I41S/D60bT/Y60gW/F97G, I41S/D60bT/Y60gW/F97G/G151H, I41S/D60bT/Y60gW/ F97G/Ins97aV, I41S/D60bT/Y60gW/F97G/Ins97aV/ G151H, I41S/D60bT/Y60gW/D96K, I41S/D60bT/Y60gW/ D96K/G151H, I41S/D60bT/Y60gW/D96K/Ins97aV, I41S/ D60bT/Y60gW/D96K/Ins97aV/G151H, I41S/D60bT/ Y60gW/D96K/F97G, I41S/D60bT/Y60gW/D96K/F97G/ G151H, I41S/D60bT/Y60gW/D96K/F97G/Ins97aV, I41S/ D60bT/Y60gW/D96K/F97G/Ins97aV/G151H, I41S/ D60bT/F60eS, I41S/D60bT/F60eS/G151H, I41S/D60bT/ F60eS/Ins97aV, I41S/D60bT/F60eS/Ins97aV/G151H, I41S/ D60bT/F60eS/F97G, I41S/D60bT/F60eS/F97G/G151H, I41S/D60bT/F60eS/F97G/Ins97aV, I41S/D60bT/F60eS/ F97G/Ins97aV/G151H, I41S/D60bT/F60eS/D96K, I41S/ D60bT/F60eS/D96K/G151H, I41S/D60bT/F60eS/D96K/ Ins97aV, I41S/D60bT/F60eS/D96K/Ins97aV/G151H, I41S/ D60bT/F60eS/D96K/F97G, I41S/D60bT/F60eS/D96K/ F97G/G151H, I41S/D60bT/F60eS/D96K/F97G/Ins97aV, I41S/D60bT/F60eS/D96K/F97G/Ins97aV/G151H, I41S/ D60bT/F60eS/Y60gW, I41S/D60bT/F60eS/Y60gW/ G151H, I41S/D60bT/F60eS/Y60gW/Ins97aV, I41S/D60bT/ F60eS/Y60gW/Ins97aV/G151H, I41S/D60bT/F60eS/ Y60gW/F97G, I41S/D60bT/F60eS/Y60gW/F97G/G151H, I41S/D60bT/F60eS/Y60gW/F97G/Ins97aV, I41S/D60bT/ F60eS/Y60gW/F97G/Ins97aV/G151H, I41S/D60bT/ F60eS/Y60gW/D96K, I41S/D60bT/F60eS/Y60gW/D96K/ G151H, I41S/D60bT/F60eS/Y60gW/D96K/Ins97aV, I41S/ D60bT/F60eS/Y60gW/D96K/Ins97aV/G151H, I41S/ D60bT/F60eS/Y60gW/D96K/F97G, I41S/D60bT/F60eS/ Y60gW/D96K/F97G/G151H, I41S/D60bT/F60eS/Y60gW/ D96K/F97G/Ins97aV, I41S/D60bT/F60eS/Y60gW/D96K/ F97G/Ins97aV/G151H, Q38H, Q38H/G151H, Q38H/ Ins97aV, Q38H/Ins97aV/G151H, Q38H/F97G, Q38H/ F97G/G151H, Q38H/F97G/Ins97aV, Q38H/F97G/Ins97aV/ G151H, Q38H/D96K, Q38H/D96K/G151H, Q38H/D96K/ Ins97aV, Q38H/D96K/Ins97aV/G151H, Q38H/D96K/ F97G, Q38H/D96K/F97G/G151H, Q38H/D96K/F97G/ Ins97aV, Q38H/D96K/F97G/Ins97aV/G151H, Q38H/ Y60gW, Q38H/Y60gW/G151H, Q38H/Y60gW/Ins97aV, Q38H/Y60gW/Ins97aV/G151H, Q38H/Y60gW/F97G, Q38H/Y60gW/F97G/G151H, Q38H/Y60gW/F97G/ Ins97aV, Q38H/Y60gW/F97G/Ins97aV/G151H, Q38H/ Y60gW/D96K, Q38H/Y60gW/D96K/G151H, Q38H/ Y60gW/D96K/Ins97aV, Q38H/Y60gW/D96K/Ins97aV/ G151H, Q38H/Y60gW/D96K/F97G, Q38H/Y60gW/D96K/ F97G/G151H, Q38H/Y60gW/D96K/F97G/Ins97aV, Q38H/ Y60gW/D96K/F97G/Ins97aV/G151H, Q38H/F60eS, Q38H/F60eS/G151H, Q38H/F60eS/Ins97aV, Q38H/F60eS/ Ins97aV/G151H, Q38H/F60eS/F97G, Q38H/F60eS/F97G/ G151H, Q38H/F60eS/F97G/Ins97aV, Q38H/F60eS/F97G/ Ins97aV/G151H, Q38H/F60eS/D96K, Q38H/F60eS/D96K/ G151H, Q38H/F60eS/D96K/Ins97aV, Q38H/F60eS/D96K/ Ins97aV/G151H, Q38H/F60eS/D96K/F97G, Q38H/F60eS/ D96K/F97G/G151H, Q38H/F60eS/D96K/F97G/Ins97aV, Q38H/F60eS/D96K/F97G/Ins97aV/G151H, Q38H/F60eS/ Y60gW, Q38H/F60eS/Y60gW/G151H, Q38H/F60eS/ Y60gW/Ins97aV, Q38H/F60eS/Y60gW/Ins97aV/G151H, Q38H/F60eS/Y60gW/F97G, Q38H/F60eS/Y60gW/F97G/ G151H, Q38H/F60eS/Y60gW/F97G/Ins97aV, Q38H/ F60eS/Y60gW/F97G/Ins97aV/G151H, Q38H/F60eS/ Y60gW/D96K, Q38H/F60eS/Y60gW/D96K/G151H, Q38H/F60eS/Y60gW/D96K/Ins97aV, Q38H/F60eS/ Y60gW/D96K/Ins97aV/G151H, Q38H/F60eS/Y60gW/ D96K/F97G, Q38H/F60eS/Y60gW/D96K/F97G/G151H, Q38H/F60eS/Y60gW/D96K/F97G/Ins97aV, Q38H/F60eS/ Y60gW/D96K/F97G/Ins97aV/G151H, Q38H/D60bT, Q38H/D60bT/G151H, Q38H/D60bT/Ins97aV, Q38H/ D60bT/Ins97aV/G151H, Q38H/D60bT/F97G, Q38H/ D60bT/F97G/G151H, Q38H/D60bT/F97G/Ins97aV, Q38H/ D60bT/F97G/Ins97aV/G151H, Q38H/D60bT/D96K, Q38H/D60bT/D96K/G151H, Q38H/D60bT/D96K/ Ins97aV, Q38H/D60bT/D96K/Ins97aV/G151H, Q38H/ D60bT/D96K/F97G, Q38H/D60bT/D96K/F97G/G151H, Q38H/D60bT/D96K/F97G/Ins97aV, Q38H/D60bT/D96K/ F97G/Ins97aV/G151H, Q38H/D60bT/Y60gW, Q38H/ D60bT/Y60gW/G151H, Q38H/D60bT/Y60gW/Ins97aV, Q38H/D60bT/Y60gW/Ins97aV/G151H, Q38H/D60bT/ Y60gW/F97G, Q38H/D60bT/Y60gW/F97G/G151H, Q38H/D60bT/Y60gW/F97G/Ins97aV, Q38H/D60bT/ Y60gW/F97G/Ins97aV/G151H, Q38H/D60bT/Y60gW/ D96K, Q38H/D60bT/Y60gW/D96K/G151H, Q38H/ D60bT/Y60gW/D96K/Ins97aV, Q38H/D60bT/Y60gW/ D96K/Ins97aV/G151H, Q38H/D60bT/Y60gW/D96K/ F97G, Q38H/D60bT/Y60gW/D96K/F97G/G151H, Q38H/ D60bT/Y60gW/D96K/F97G/Ins97aV, Q38H/D60bT/ Y60gW/D96K/F97G/Ins97aV/G151H, Q38H/D60bT/ F60eS, Q38H/D60bT/F60eS/G151H, Q38H/D60bT/F60eS/ Ins97aV, Q38H/D60bT/F60eS/Ins97aV/G151H, Q38H/ D60bT/F60eS/F97G, Q38H/D60bT/F60eS/F97G/G151H, Q38H/D60bT/F60eS/F97G/Ins97aV, Q38H/D60bT/F60eS/ F97G/Ins97aV/G151H, Q38H/D60bT/F60eS/D96K, Q38H/ D60bT/F60eS/D96K/G151H, Q38H/D60bT/F60eS/D96K/ Ins97aV, Q38H/D60bT/F60eS/D96K/Ins97aV/G151H, Q38H/D60bT/F60eS/D96K/F97G, Q38H/D60bT/F60eS/ D96K/F97G/G151H, Q38H/D60bT/F60eS/D96K/F97G/ Ins97aV, Q38H/D60bT/F60eS/D96K/F97G/Ins97aV/ G151H, Q38H/D60bT/F60eS/Y60gW, Q38H/D60bT/ F60eS/Y60gW/G151H, Q38H/D60bT/F60eS/Y60gW/ Ins97aV, Q38H/D60bT/F60eS/Y60gW/Ins97aV/G151H, Q38H/D60bT/F60eS/Y60gW/F97G, Q38H/D60bT/F60eS/ Y60gW/F97G/G151H, Q38H/D60bT/F60eS/Y60gW/ F97G/Ins97aV, Q38H/D60bT/F60eS/Y60gW/F97G/

Ins97aV/G151H, Q38H/D60bT/F60eS/Y60gW/D96K, Q38H/D60bT/F60eS/Y60gW/D96K/G151H, Q38H/D60bT/F60eS/Y60gW/D96K/Ins97aV, Q38H/D60bT/F60eS/Y60gW/D96K/Ins97aV/G151H, Q38H/D60bT/F60eS/Y60gW/D96K/F97G, Q38H/D60bT/F60eS/Y60gW/D96K/F97G/G151H, Q38H/D60bT/F60eS/Y60gW/D96K/F97G/Ins97aV, Q38H/D60bT/F60eS/Y60gW/D96K/F97G/Ins

Q175L/Q192D, F60eS/T98P/F99L/C122S/G151H/Q175L/Q192D, F60eS/Ins97aV/T98P/F99L/C122S/Q175L/Q192D, F60eS/Ins97aV/T98P/F99L/C122S/G151H/Q175L/Q192D, F60eS/F97G/T98P/F99L/C122S/Q175L/Q192D, F60eS/F97G/T98P/F99L/C122S/G151H/Q175L/Q192D, F60eS/F97G/Ins97aV/T98P/F99L/C122S/Q175L/Q192D, F60eS/D96K/T98P/F99L/C122S/Q175L/Q192D, F60eS/D96K/T98P/F99L/C122S/G151H/Q175L/Q192D, F60eS/D96K/Ins97aV/T98P/F99L/C122S/Q175L/Q192D, F60eS/D96K/Ins97aV/T98P/F99L/C122S/G151H/Q175L/Q192D, F60eS/D96K/F97G/T98P/F99L/C122S/Q175L/Q192D, F60eS/D96K/F97G/T98P/F99L/C122S/G151H/Q175L/Q192D, F60eS/D96K/F97G/Ins97aV/T98P/F99L/C122S/Q175L/Q192D, F60eS/D96K/F97G/Ins97aV/T98P/F99L/C122S/G151H/Q175L/Q192D, F60eS/Y60gW/T98P/F99L/C122S/Q175L/Q192D, F60eS/Y60gW/T98P/F99L/C122S/G151H/Q175L/Q192D, F60eS/Y60gW/Ins97aV/T98P/F99L/C122S/Q175L/Q192D, F60eS/Y60gW/Ins97aV/T98P/F99L/C122S/G151H/Q175L/Q192D, F60eS/Y60gW/F97G/T98P/F99L/C122S/Q175L/Q192D, F60eS/Y60gW/F97G/T98P/F99L/C122S/G151H/Q175L/Q192D, F60eS/Y60gW/F97G/Ins97aV/T98P/F99L/C122S/Q175L/Q192D, F60eS/Y60gW/F97G/Ins97aV/T98P/F99L/C122S/G151H/Q175L/Q192D, F60eS/Y60gW/D96K/T98P/F99L/C122S/Q175L/Q192D, F60eS/Y60gW/D96K/T98P/F99L/C122S/G151H/Q175L/Q192D, F60eS/Y60gW/D96K/Ins97aV/T98P/F99L/C122S/Q175L/Q192D, F60eS/Y60gW/D96K/Ins97aV/T98P/F99L/C122S/G151H/Q175L/Q192D, F60eS/Y60gW/D96K/F97G/T98P/F99L/C122S/Q175L/Q192D, F60eS/Y60gW/D96K/F97G/T98P/F99L/C122S/G151H/Q175L/Q192D, F60eS/Y60gW/D96K/F97G/Ins97aV/T98P/F99L/C122S/Q175L/Q192D, F60eS/Y60gW/D96K/F97G/Ins97aV/T98P/F99L/C122S/G151H/Q175L/Q192D, D60bT/T98P/F99L/C122S/Q175L/Q192D, D60bT/T98P/F99L/C122S/G151H/Q175L/Q192D, D60bT/Ins97aV/T98P/F99L/C122S/Q175L/Q192D, D60bT/Ins97aV/T98P/F99L/C122S/G151H/Q175L/Q192D, D60bT/F97G/T98P/F99L/C122S/Q175L/Q192D, D60bT/F97G/T98P/F99L/C122S/G151H/Q175L/Q192D, D60bT/F97G/Ins97aV/T98P/F99L/C122S/Q175L/Q192D, D60bT/F97G/Ins97aV/T98P/F99L/C122S/G151H/Q175L/Q192D, D60bT/D96K/T98P/F99L/C122S/Q175L/Q192D, D60bT/D96K/T98P/F99L/C122S/G151H/Q175L/Q192D, D60bT/D96K/Ins97aV/T98P/F99L/C122S/Q175L/Q192D, D60bT/D96K/Ins97aV/T98P/F99L/C122S/G151H/Q175L/Q192D, D60bT/D96K/F97G/T98P/F99L/C122S/Q175L/Q192D, D60bT/D96K/F97G/T98P/F99L/C122S/G151H/Q175L/Q192D, D60bT/D96K/F97G/Ins97aV/T98P/F99L/C122S/Q175L/Q192D, D60bT/D96K/F97G/Ins97aV/T98P/F99L/C122

G151H/Q175L/Q192D, I41S/Y60gW/D96K/T98P/F99L/C122S/Q175L/Q192D, I41S/Y60gW/D96K/T98P/F99L/C122S/G151H/Q175L/Q192D, I41S/Y60gW/D96K/Ins97aV/T98P/F99L/C122S/Q175L/Q192D, I41S/Y60gW/D96K/Ins97aV/T98P/F99L/C122S/G151H/Q175L/Q192D, I41S/Y60gW/D96K/F97G/T98P/F99L/C122S/Q175L/Q192D, I41S/Y60gW/D96K/F97G/T98P/F99L/C122S/G151H/Q175L/Q192D, I41S/Y60gW/D96K/F97G/Ins97aV/T98P/F99L/C122S/Q175L/Q192D, I41S/Y60gW/D96K/F97G/Ins97aV/T98P/F99L/C122S/G151H/Q175L/Q192D, I41S/F60eS/T98P/F99L/C122S/Q175L/Q192D, I41S/F60eS/T98P/F99L/C122S/G151H/Q175L/Q192D, I41S/F60eS/Ins97aV/T98P/F99L/C122S/Q175L/Q192D, I41S/F60eS/Ins97aV/T98P/F99L/C122S/G151H/Q175L/Q192D, I41S/F60eS/F97G/T98P/F99L/C122S/Q175L/Q192D, I41S/F60eS/F97G/T98P/F99L/C122S/G151H/Q175L/Q192D, I41S/F60eS/F97G/Ins97aV/T98P/F99L/C122S/Q175L/Q192D, I41S/F60eS/F97G/Ins97aV/T98P/F99L/C122S/G151H/Q175L/Q192D, I41S/F60eS/D96K/T98P/F99L/C122S/Q175L/Q192D, I41S/F60eS/D96K/T98P/F99L/C122S/G151H/Q175L/Q192D, I41S/F60eS/D96K/Ins97aV/T98P/F99L/C122S/Q175L/Q192D, I41S/F60eS/D96K/Ins97aV/T98P/F99L/C122S/G151H/Q175L/Q192D, I41S/F60eS/D96K/F97G/T98P/F99L/C122S/Q175L/Q192D, I41S/F60eS/D96K/F97G/T98P/F99L/C122S/G151H/Q175L/Q192D, I41S/F60eS/D96K/F97G/Ins97aV/T98P/F99L/C122S/Q175L/Q192D, I41S/F60eS/D96K/F97G/Ins97aV/T98P/F99L/C122S/G151H/Q175L/Q192D, I41S/F60eS/Y60gW/T98P/F99L/C122S/Q175L/Q192D, I41S/F60eS/Y60gW/T98P/F99L/C122S/G151H/Q175L/Q192D, I41S/F60eS/Y60gW/Ins97aV/T98P/F99L/C122S/Q175L/Q192D, I41S/F60eS/Y60gW/Ins97aV/T98P/F99L/C122S/G151H/Q175L/Q192D, I41S/F60eS/Y60gW/F97G/T98P/F99L/C122S/Q175L/Q192D, I41S/F60eS/Y60gW/F97G/T98P/F99L/C122S/G151H/Q175L/Q192D, I41S/F60eS/Y60gW/F97G/Ins97aV/T98P/F99L/C122S/Q175L/Q192D, I41S/F60eS/Y60gW/F97G/Ins97aV/T98P/F99L/C122S/G151H/Q175L/Q192D, I41S/F60eS/Y60gW/D96K/T98P/F99L/C122S/Q175L/Q192D, I41S/F60eS/Y60gW/D96K/T98P/F99L/C122S/G151H/Q175L/Q192D, I41S/F60eS/Y60gW/D96K/Ins97aV/T98P/F99L/C122S/Q175L/Q192D, I41S/F60eS/Y60gW/D96K/Ins97aV/T98P/F99L/C122S/G151H/Q175L/Q192D, I41S/F60eS/Y60gW/D96K/F97G/T98P/F99L/C122S/Q175L/Q192D, I41S/F60eS/Y60gW/D96K/F97G/T98P/F99L/C122S/G151H/Q175L/Q192D, I41S/F60eS/Y60gW/D96K/F97G/Ins97aV/T98P/F99L/C122S/Q175L/Q192D, I41S/F60eS/Y60gW/D96K/F97G/Ins97aV/T98P/F99L/C122S/G151H/Q175L/Q192D, I41S/D60bT/T98P/F99L/C122S/Q175L/Q192D, I41S/D60bT/T98P/F99L/C122S/G151H/Q175L/Q192D, I41S/D60bT/Ins97aV/T98P/F99L/C122S/Q175L/Q192D, I41S/D60bT/Ins97aV/T98P/F99L/C122S/G151H/Q175L/Q192D, I41S/D60bT/F97G/T98P/F99L/C122S/Q175L/Q192D, I41S/D60bT/F97G/T98P/F99L/C122S/G151H/Q175L/Q192D, I41S/D60bT/F97G/Ins97aV/T98P/F99L/C122S/Q175L/Q192D, I41S/D60bT/F97G/Ins97aV/T98P/F99L/C122S/G151H/Q175L/Q192D, I41S/D60bT/D96K/T98P/F99L/C122S/Q175L/Q192D, I41S/D60bT/D96K/T98P/F99L/C122S/G151H/Q175L/Q192D, I41S/D60bT/D96K/Ins97aV/T98P/F99L/C122S/Q175L/Q192D, I41S/D60bT/D96K/Ins97aV/T98P/F99L/C122S/G151H/Q175L/Q192D, I41S/D60bT/D96K/F97G/T98P/F99L/C122S/G151H/Q175L/Q192D, I41S/D60bT/D96K/F97G/Ins97aV/T98P/F99L/C122S/Q175L/Q192D, I41S/D60bT/D96K/F97G/Ins97aV/T98P/F99L/C122S/G151H/Q175L/Q192D, I41S/D60bT/Y60gW/T98P/F99L/C122S/Q175L/Q192D, I41S/D60bT/Y60gW/T98P/F99L/C122S/G151H/Q175L/Q192D, I41S/D60bT/Y60gW/Ins97aV/T98P/F99L/C122S/Q175L/Q192D, I41S/D60bT/Y60gW/Ins97aV/T98P/F99L/C122S/G151H/Q175L/Q192D, I41S/D60bT/Y60gW/F97G/T98P/F99L/C122S/Q175L/Q192D, I41S/D60bT/Y60gW/F97G/T98P/F99L/C122S/G151H/Q175L/Q192D, I41S/D60bT/Y60gW/F97G/Ins97aV/T98P/F99L/C122S/Q175L/Q192D, I41S/D60bT/Y60gW/F97G/Ins97aV/T98P/F99L/C122S/G151H/Q175L/Q192D, I41S/D60bT/Y60gW/D96K/T98P/F99L/C122S/Q175L/Q192D, I41S/D60bT/Y60gW/D96K/T98P/F99L/C122S/G151H/Q175L/Q192D, I41S/D60bT/Y60gW/D96K/Ins97aV/T98P/F99L/C122S/Q175L/Q192D, I41S/D60bT/Y60gW/D96K/Ins97aV/T98P/F99L/C122S/G151H/Q175L/Q192D, I41S/D60bT/Y60gW/D96K/F97G/T98P/F99L/C122S/Q175L/Q192D, I41S/D60bT/Y60gW/D96K/F97G/T98P/F99L/C122S/G151H/Q175L/Q192D, I41S/D60bT/Y60gW/D96K/F97G/Ins97aV/T98P/F99L/C122S/Q175L/Q192D, I41S/D60bT/Y60gW/D96K/F97G/Ins97aV/T98P/F99L/C122S/G151H/Q175L/Q192 D, I41S/D60bT/F60eS/T98P/F99L/C122S/Q175L/Q192D, I41S/D60bT/F60eS/T98P/F99L/C122S/G151H/Q175L/Q192D, I41S/D60bT/F60eS/Ins97aV/T98P/F99L/C122S/Q175L/Q192D, I41S/D60bT/F60eS/Ins97aV/T98P/F99L/C122S/G151H/Q175L/Q192D, I41S/D60bT/F60eS/F97G/T98P/F99L/C122S/Q175L/Q192D, I41S/D60bT/F60eS/F97G/T98P/F99L/C122S/G151H/Q175L/Q192D, I41S/D60bT/F60eS/F97G/Ins97aV/T98P/F99L/C122S/Q175L/Q192D, I41S/D60bT/F60eS/F97G/Ins97aV/T98P/F99L/C122S/G151H/Q175L/Q192D, I41S/D60bT/F60eS/D96K/T98P/F99L/C122S/Q175L/Q192D, I41S/D60bT/F60eS/D96K/T98P/F99L/C122S/G151H/Q175L/Q192D, I41S/D60bT/F60eS/D96K/Ins97aV/T98P/F99L/C122S/Q175L/Q192D, I41S/D60bT/F60eS/D96K/Ins97aV/T98P/F99L/C122S/G151H/Q175L/Q192D, I41S/D60bT/F60eS/D96K/F97G/T98P/F99L/C122S/Q175L/Q192D, I41S/D60bT/F60eS/D96K/F97

F97G/T98P/F99L/C122S/G151H/Q175L/Q192D, Q38H/ F97G/Ins97aV/T98P/F99L/C122S/Q175L/Q192D, Q38H/ F97G/Ins97aV/T98P/F99L/C122S/G151H/Q175L/Q192D, Q38H/D96K/T98P/F99L/C122S/Q175L/Q192D, Q38H/ D96K/T98P/F99L/C122S/G151H/Q175L/Q192D, Q38H/ D96K/Ins97aV/T98P/F99L/C122S/Q175L/Q192D, Q38H/ D96K/Ins97aV/T98P/F99L/C122S/G151H/Q175L/Q192D, Q38H/D96K/F97G/T98P/F99L/C122S/Q175L/Q192D, Q38H/D96K/F97G/T98P/F99L/C122S/G151H/Q175L/ Q192D, Q38H/D96K/F97G/Ins97aV/T98P/F99L/C122S/ Q175L/Q192D, Q38H/D96K/F97G/Ins97aV/T98P/F99L/ C122S/G151H/Q175L/Q192D, Q38H/Y60gW/T98P/F99L/ C122S/Q175L/Q192D, Q38H/Y60gW/T98P/F99L/C122S/ G151H/Q175L/Q192D, Q38H/Y60gW/Ins97aV/T98P/ F99L/C122S/Q175L/Q192D, Q38H/Y60gW/Ins97aV/ T98P/F99L/C122S/G151H/Q175L/Q192D, Q38H/Y60gW/ F97G/T98P/F99L/C122S/Q175L/Q192D, Q38H/Y60gW/ F97G/T98P/F99L/C122S/G151H/Q175L/Q192D, Q38H/ Y60gW/F97G/Ins97aV/T98P/F99L/C122S/Q175L/Q192D, Q38H/Y60gW/F97G/Ins97aV/T98P/F99L/C122S/G151H/ Q175L/Q192D, Q38H/Y60gW/D96K/T98P/F99L/C122S/ Q175L/Q192D, Q38H/Y60gW/D96K/T98P/F99L/C122S/ G151H/Q175L/Q192D, Q38H/Y60gW/D96K/Ins97aV/ T98P/F99L/C122S/Q175L/Q192D, Q38H/Y60gW/D96K/ Ins97aV/T98P/F99L/C122S/G151H/Q175L/Q192D, Q38H/Y60gW/D96K/F97G/T98P/F99L/C122S/Q175L/ Q192D, Q38H/Y60gW/D96K/F97G/T98P/F99L/C122S/ G151H/Q175L/Q192D, Q38H/Y60gW/D96K/F97G/ Ins97aV/T98P/F99L/C122S/Q175L/Q192D, Q38H/ Y60gW/D96K/F97G/Ins97aV/T98P/F99L/C122S/G151H/ Q175L/Q192D, Q38H/F60eS/T98P/F99L/C122S/Q175L/ Q192D, Q38H/F60eS/T98P/F99L/C122S/G151H/Q175L/ Q192D, Q38H/F60eS/Ins97aV/T98P/F99L/C122S/Q175L/ Q192D, Q38H/F60eS/Ins97aV/T98P/F99L/C122S/G151H/ Q175L/Q192D, Q38H/F60eS/F97G/T98P/F99L/C122S/ Q175L/Q192D, Q38H/F60eS/F97G/T98P/F99L/C122S/ G151H/Q175L/Q192D, Q38H/F60eS/F97G/Ins97aV/T98P/ F99L/C122S/Q175L/Q192D, Q38H/F60eS/F97G/Ins97aV/ T98P/F99L/C122S/G151H/Q175L/Q192D, Q38H/F60eS/ D96K/T98P/F99L/C122S/Q175L/Q192D, Q38H/F60eS/ D96K/T98P/F99L/C122S/G151H/Q175L/Q192D, Q38H/ F60eS/D96K/Ins97aV/T98P/F99L/C122S/Q175L/Q192D, Q38H/F60eS/D96K/Ins97aV/T98P/F99L/C122S/G151H/ Q175L/Q192D, Q38H/F60eS/D96K/F97G/T98P/F99L/ C122S/Q175L/Q192D, Q38H/F60eS/D96K/F97G/T98P/ F99L/C122S/G151H/Q175L/Q192D, Q38H/F60eS/D96K/ F97G/Ins97aV/T98P/F99L/C122S/Q175L/Q192D, Q38H/ F60eS/D96K/F97G/Ins97aV/T98P/F99L/C122S/G151H/ Q175L/Q192D, Q38H/F60eS/Y60gW/T98P/F99L/C122S/ Q175L/Q192D, Q38H/F60eS/Y60gW/T98P/F99L/C122S/ G151H/Q175L/Q192D, Q38H/F60eS/Y60gW/Ins97aV/ T98P/F99L/C122S/Q175L/Q192D, Q38H/F60eS/Y60gW/ Ins97aV/T98P/F99L/C122S/G151H/Q175L/Q192D, Q38H/F60eS/Y60gW/F97G/T98P/F99L/C122S/Q175L/ Q192D, Q38H/F60eS/Y60gW/F97G/T98P/F99L/C122S/ G151H/Q175L/Q192D, Q38H/F60eS/Y60gW/F97G/ Ins97aV/T98P/F99L/C122S/Q175L/Q192D, Q38H/F60eS/ Y60gW/F97G/Ins97aV/T98P/F99L/C122S/G151H/Q175L/ Q192D, Q38H/F60eS/Y60gW/D96K/T98P/F99L/C122S/ Q175L/Q192D, Q38H/F60eS/Y60gW/D96K/T98P/F99L/ C122S/G151H/Q175L/Q192D, Q38H/F60eS/Y60gW/ D96K/Ins97aV/T98P/F99L/C122S/Q175L/Q192D, Q38H/ F60eS/Y60gW/D96K/Ins97aV/T98P/F99L/C122S/G151H/ Q175L/Q192D, Q38H/F60eS/Y60gW/D96K/F97G/T98P/ F99L/C122S/Q175L/Q192D, Q38H/F60eS/Y60gW/D96K/ F97G/T98P/F99L/C122S/G151H/Q175L/Q192D, Q38H/ F60eS/Y60gW/D96K/F97G/Ins97aV/T98P/F99L/C122S/ Q175L/Q192D, Q38H/F60eS/Y60gW/D96K/F97G/ Ins97aV/T98P/F99L/C122S/G151H/Q175L/Q192 D, Q38H/D60bT/T98P/F99L/C122S/Q175L/Q192D, Q38H/ D60bT/T98P/F99L/C122S/G151H/Q175L/Q192D, Q38H/ D60bT/Ins97aV/T98P/F99L/C122S/Q175L/Q192D, Q38H/ D60bT/Ins97aV/T98P/F99L/C122S/G151H/Q175L/ Q192D, Q38H/D60bT/F97G/T98P/F99L/C122S/Q175L/ Q192D, Q38H/D60bT/F97G/T98P/F99L/C122S/G151H/ Q175L/Q192D, Q38H/D60bT/F97G/Ins97aV/T98P/F99L/ C122S/Q175L/Q192D, Q38H/D60bT/F97G/Ins97aV/ T98P/F99L/C122S/G151H/Q175L/Q192D, Q38H/D60bT/ D96K/T98P/F99L/C122S/Q175L/Q192D, Q38H/D60bT/ D96K/T98P/F99L/C122S/G151H/Q175L/Q192D, Q38H/ D60bT/D96K/Ins97aV/T98P/F99L/C122S/Q175L/Q192D, Q38H/D60bT/D96K/Ins97aV/T98P/F99L/C122S/G151H/ Q175L/Q192D, Q38H/D60bT/D96K/F97G/T98P/F99L/ C122S/Q175L/Q192D, Q38H/D60bT/D96K/F97G/T98P/ F99L/C122S/G151H/Q175L/Q192D, Q38H/D60bT/D96K/ F97G/Ins97aV/T98P/F99L/C122S/Q175L/Q192D, Q38H/ D60bT/D96K/F97G/Ins97aV/T98P/F99L/C122S/G151H/ Q175L/Q

Q192D, Q38H/D60bT/F60eS/Y60gW/F97G/T98P/F99L/C122S/Q175L/Q192D, Q38H/D60bT/F60eS/Y60gW/F97G/T98P/F99L/C122S/G151H/Q175L/Q192D, Q38H/D60bT/F60eS/Y60gW/F97G/Ins97aV/T98P/F99L/C122S/Q175L/Q192D, Q38H/D60bT/F60eS/Y60gW/F97G/Ins97aV/T98P/F99L/C122S/G151H/Q175L/Q19 2D, Q38H/D60bT/F60eS/Y60gW/D96K/T98P/F99L/C122S/Q175L/Q192D, Q38H/D60bT/F60eS/Y60gW/D96K/T98P/F99L/C122S/G151H/Q175L/Q192D, Q38H/D60bT/F60eS/Y60gW/D96K/Ins97aV/T98P/F99L/C122S/Q175L/Q192D, Q38H/D60bT/F60eS/Y60gW/D96K/Ins97aV/T98P/F99L/C122S/G151H/Q175L/Q19 2D, Q38H/D60bT/F60eS/Y60gW/D96K/F97G/T98P/F99L/C122S/Q175L/Q192D, Q38H/D60bT/F60eS/Y60gW/D96K/F97G/T98P/F99L/C122S/G151H/Q175L/Q192D, Q38H/D60bT/F60eS/Y60gW/D96K/F97G/Ins97aV/T98P/F99L/C122S/Q175L/Q192 D, Q38H/D60bT/F60eS/Y60gW/D96K/F97G/Ins97aV/T98P/F99L/C122S/G151H/Q1 75L/Q192D, Q38H/I41S/T98P/F99L/C122S/Q175L/Q192D, Q38H/I41S/T98P/F99L/C122S/G151H/Q175L/Q192D, Q38H/I41S/Ins97aV/T98P/F99L/C122S/Q175L/Q192D, Q38H/I41S/Ins97aV/T98P/F99L/C122S/G151H/Q175L/Q192D, Q38H/I41S/F97G/T98P/F99L/C122S/Q175L/Q192D, Q38H/I41S/F97G/T98P/F99L/C122S/G151H/Q175L/Q192D, Q38H/I41S/F97G/Ins97aV/T98P/F99L/C122S/Q175L/Q192D, Q38H/I41S/F97G/Ins97aV/T98P/F99L/C122S/G151H/Q175L/Q192D, Q38H/I41S/D96K/T98P/F99L/C122S/Q175L/Q192D, Q38H/I41S/D96K/T98P/F99L/C122S/G151H/Q175L/Q192D, Q38H/I41S/D96K/Ins97aV/T98P/F99L/C122S/Q175L/Q192D, Q38H/I41S/D96K/Ins97aV/T98P/F99L/C122S/G151H/Q175L/Q192D, Q38H/I41S/D96K/F97G/T98P/F99L/C122S/Q175L/Q192D, Q38H/I41S/D96K/F97G/T98P/F99L/C122S/G151H/Q175L/Q192D, Q38H/I41S/D96K/F97G/Ins97aV/T98P/F99L/C122S/Q175L/Q192D, Q38H/I41S/D96K/F97G/Ins97aV/T98P/F99L/C122S/G151H/Q175L/Q192D, Q38H/I41S/Y60gW/T98P/F99L/C122S/Q175L/Q192D, Q38H/I41S/Y60gW/T98P/F99L/C122S/G151H/Q175L/Q192D, Q38H/I41S/Y60gW/Ins97aV/T98P/F99L/C122S/Q175L/Q192D, Q38H/I41S/Y60gW/Ins97aV/T98P/F99L/C122S/G151H/Q175L/Q192D, Q38H/I41S/Y60gW/F97G/T98P/F99L/C122S/Q175L/Q192D, Q38H/I41S/Y60gW/F97G/T98P/F99L/C122S/G151H/Q175L/Q192D, Q38H/I41S/Y60gW/F97G/Ins97aV/T98P/F99L/C122S/Q175L/Q192D, Q38H/I41S/Y60gW/F97G/Ins97aV/T98P/F99L/C122S/G151H/Q175L/Q192D, Q38H/I41S/Y60gW/D96K/T98P/F99L/C122S/Q175L/Q192D, Q38H/I41S/Y60gW/D96K/T98P/F99L/C122S/G151H/Q175L/Q192D, Q38H/I41S/Y60gW/D96K/Ins97aV/T98P/F99L/C122S/Q175L/Q192D, Q38H/I41S/Y60gW/D96K/Ins97aV/T98P/F99L/C122S/G151H/Q175L/Q192D, Q38H/I41S/Y60gW/D96K/F97G/T98P/F99L/C122S/Q175L/Q192D, Q38H/I41S/Y60gW/D96K/F97G/T98P/F99L/C122S/G151H/Q175L/Q192D, Q38H/I41S/Y60gW/D96K/F97G/Ins97aV/T98P/F99L/C122S/Q175L/Q192D, Q38H/I41S/Y60gW/D96K/F97G/Ins97aV/T98P/F99L/C122S/G151H/Q175L/Q192D, Q38H/I41S/F60eS/T98P/F99L/C122S/Q175L/Q192D, Q38H/I41S/F60eS/T98P/F99L/C122S/G151H/Q175L/Q192D, Q38H/I41S/F60eS/Ins97aV/T98P/F99L/C122S/Q175L/Q192D, Q38H/I41S/F60eS/Ins97aV/T98P/F99L/C122S/G151H/Q175L/Q192D, Q38H/I41S/F60eS/F97G/T98P/F99L/C122S/Q175L/Q192D, Q38H/I41S/F60eS/F97G/T98P/F99L/C122S/G151H/Q175L/Q192D, Q38H/I41S/F60eS/F97G/Ins97aV/T98P/F99L/C122S/Q175L/Q192D, Q38H/I41S/F60eS/F97G/Ins97aV/T98P/F99L/C122S/G151H/Q175L/Q192D, Q38H/I41S/F60eS/D96K/T98P/F99L/C122S/Q175L/Q192D, Q38H/I41S/F60eS/D96K/T98P/F99L/C122S/G151H/Q175L/Q192D, Q38H/I41S/F60eS/D96K/Ins97aV/T98P/F99L/C122S/Q175L/Q192D, Q38H/I41S/F60eS/D96K/Ins97aV/T98P/F99L/C122S/G151H/Q175L/Q192D, Q38H/I41S/F60eS/D96K/F97G/T98P/F99L/C122S/Q175L/Q192D, Q38H/I41S/F60eS/D96K/F97G/T98P/F99L/C122S/G151H/Q175L/Q192D, Q38H/I41S/F60eS/D96K/F97G/Ins97aV/T98P/F99L/C122S/Q175L/Q192D, Q38H/I41S/F60eS/D96K/F97G/Ins97aV/T98P/F99L/C122S/G151H/Q175L/Q192D, Q38H/I41S/F60eS/Y60gW/T98P/F99L/C122S/Q175L/Q192D, Q38H/I41S/F60eS/Y60gW/T98P/F99L/C122S/G151H/Q175L/Q192D, Q38H/I41S/F60eS/Y60gW/Ins97aV/T98P/F99L/C122S/Q175L/Q192D, Q38H/I41S/F60eS/Y60gW/Ins97aV/T98P/F99L/C122S/G151H/Q175L/Q192D, Q38H/I41S/F60eS/Y60gW/F97G/T98P/F99L/C122S/Q175L/Q192D, Q38H/I41S/F60eS/Y60gW/F97G/T98P/F99L/C122S/G151H/Q175L/Q192D, Q38H/I41S/F60eS/Y60gW/F97G/Ins97aV/T98P/F99L/C122S/Q175L/Q192D, Q38H/I41S/F60eS/Y60gW/F97G/Ins97aV/T98P/F99L/C122S/G151H/Q175L/Q192D, Q38H/I41S/F60eS/Y60gW/D96K/T98P/F99L/C122S/Q175L/Q192D, Q38H/I41S/F60eS/Y60gW/D96K/T98P/F99L/C122S/G151H/Q175L/Q192D, Q38H/I41S/F60eS/Y60gW/D96K/Ins97aV/T98P/F99L/C122S/Q175L/Q192D, Q38H/I41S/F60eS/Y60gW/D96K/Ins97aV/T98P/F99L/C122S/G151H/Q175L/Q192 D, Q38H/I41S/F60eS/Y60gW/D96K/F97G/T98P/F99L/C122S/Q175L/Q192D, Q38H/I41S/F60eS/Y60gW/D96K/F97G/T98P/F99L/C122S/G151H/Q175L/Q192D, Q38H/I41S/F60eS/Y60gW/D96K/F97G/Ins97aV/T98P/F99L/C122S/Q175L/Q192D, Q38H/I41S/F60eS/Y60gW/D96K/F97G/Ins97aV/T98P/F99L/C122S/G151H/Q175L/Q192D, Q38H/I41S/D60bT/T98P/F99L/C122S/Q175L/Q192D, Q38H/I41S/D60bT/T98P/F99L/C122S/G151H/Q175L/Q192D, Q38H/I41S/D60bT/Ins97aV/T98P/F99L/C122S/Q175L/Q192D, Q38H/I41S/D60bT/Ins97aV/T98P/F99L/C122S/G151H/Q175L/Q192D, Q38H/I41S/D60bT/F97G/T98P/F99L/C122S/Q175L/Q192D, Q38H/I41S/D60bT/F97G/T98P/F99L/C122S/G151H/Q175L/Q192D, Q38H/I41S/D60bT/F97G/Ins97aV/T98P/F99L/C122S/Q175L/Q192D, Q38H/I41S/D60bT/F97G/Ins97aV/T98P/F99L/C122S/G151H/Q175L/Q192D, Q38H/I41S/D60bT/D96K/T98P/F99L/C122S/Q175L/Q192D, Q38H/I41S/D60bT/D96K/T98P/F99L/C122S/G151H/Q175L/Q192D, Q38H/I41S/D60bT/D96K/Ins97aV/T98P/F99L/C122S/Q175L/Q192D, Q38H/I41S/D60bT/D96K/Ins97aV/T98P/F99L/C122S/G151H/Q175L/Q192D, Q38H/I41S/D60bT/D96K/F97G/T98P/F99L/C122S/Q175L/Q192D, Q38H/I41S/D60bT/D96K/F97G/T98P/F99L/C122S/G151H/Q175L/Q192D, Q38H/I41S/D60bT/D96K/F97G/Ins97aV/T98P/F99L/C122S/Q175L/Q192D, Q38H/I41S/D60bT/D96K/F97G/Ins97aV/T98P/F99L/C122S/G151H/Q175L/Q192D, Q38H/I41S/D60bT/Y60gW/T98P/F99L/C122S/Q175L/Q192D, Q38H/I41S/D60bT/Y60gW/T98P/F99L/C122S/G151H/Q175L/Q192D, Q38H/I41S/D60bT/Y60gW/Ins97aV/T98P/F99L/C122S/Q175L/Q192D, Q38H/I41S/D60bT/Y60gW/Ins97aV/T98P/F99L/C122S/G151H/Q175L/Q192D, Q38H/I41S/D60bT/Y60gW/F97G/T98P/F99L/C122S/Q175L/Q192D, Q38H/I41S/D60bT/Y60gW/F97G/T98P/F99L/C122S/G151H/Q175L/Q192D, Q38H/I41S/D60bT/Y60gW/F97G/Ins97aV/T98P/F99L/C122S/Q175L/Q192D, Q38H/I41S/D60bT/Y60gW/F97G/Ins97aV/T98P/F99L/C122S/G151H/Q175L/Q192 D, Q38H/I41S/D60bT/Y60gW/D96K/T98P/F99L/C122S/Q175L/Q192D, Q38H/I41S/D60bT/Y60gW/D96K/T98P/F99L/C122S/G151H/Q175L/Q192D, Q38H/I41S/D60bT/Y60gW/D96K/Ins97aV/T98P/F99L/C122S/Q175L/Q192D, Q38H/I41S/D60bT/Y60gW/D96K/Ins97aV/T98P/

F99L/C122S/G151H/Q175L/Q192 D, Q38H/I41S/D60bT/
Y60gW/D96K/F97G/T98P/F99L/C122S/Q175L/Q192D,
Q38H/I41S/D60bT/Y60gW/D96K/F97G/T98P/F99L/
C122S/G151H/Q175L/Q192D, Q38H/I41S/D60bT/
Y60gW/D96K/F97G/Ins97aV/T98P/F99L/C122S/Q175L/
Q192D, Q38H/I41S/D60bT/Y60gW/D96K/F97G/Ins97aV/
T98P/F99L/C122S/G151H/Q175L/Q192D, Q38H/I41S/
D60bT/F60eS/T98P/F99L/C122S/Q175L/Q192D, Q38H/
I41S/D60bT/F60eS/T98P/F99L/C122S/G151H/Q175L/
Q192D, Q38H/I41S/D60bT/F60eS/Ins97aV/T98P/F99L/
C122S/Q175L/Q192D, Q38H/I41S/D60bT/F60eS/
Ins97aV/T98P/F99L/C122S/G151H/Q175L/Q192D,
Q38H/I41S/D60bT/F60eS/F97G/T98P/F99L/C122S/
Q175L/Q192D, Q38H/I41S/D60bT/F60eS/F97G/T98P/
F99L/C122S/G151H/Q175L/Q192D, Q38H/I41S/D60bT/
F60eS/F97G/Ins97aV/T98P/F99L/C122S/Q175L/Q192D,
Q38H/I41S/D60bT/F60eS/F97G/Ins97aV/T98P/F99L/
C122S/G151H/Q175L/Q192D, Q38H/I41S/D60bT/F60eS/
D96K/T98P/F99L/C122S/Q175L/Q192D, Q38H/I41S/
D60bT/F60eS/D96K/T98P/F99L/C122S/G151H/Q175L/
Q192D, Q38H/I41S/D60bT/F60eS/D96K/Ins97aV/T98P/
F99L/C122S/Q175L/Q192D, Q38H/I41S/D60bT/F60eS/
D96K/Ins97aV/T98P/F99L/C122S/G151H/Q175L/Q192D,
Q38H/I41S/D60bT/F60eS/D96K/F97G/T98P/F99L/C122S/
Q175L/Q192D, Q38H/I41S/D60bT/F60eS/D96K/F97G/
T98P/F99L/C122S/G151H/Q175L/Q192D, Q38H/I41S/
D60bT/F60eS/D96K/F97G/Ins97aV/T98P/F99L/C122S/
Q175L/Q192D, Q38H/I41S/D60bT/F60eS/D96K/F97G/
Ins97aV/T98P/F99L/C122S/G151H/Q175L/Q192D,
Q38H/I41S/D60bT/F60eS/Y60gW/T98P/F99L/C122S/
Q175L/Q192D, Q38H/I41S/D60bT/F60eS/Y60gW/T98P/
F99L/C122S/G151H/Q175L/Q192D, Q38H/I41S/D60bT/
F60eS/Y60gW/Ins97aV/T98P/F99L/C122S/Q175L/
Q192D, Q38H/I41S/D60bT/F60eS/Y60gW/Ins97aV/T98P/
F99L/C122S/G151H/Q175L/Q192 D, Q38H/I41S/D60bT/
F60eS/Y60gW/F97G/T98P/F99L/C122S/Q175L/Q192D,
Q38H/I41S/D60bT/F60eS/Y60gW/F97G/T98P/F99L/
C122S/G151H/Q175L/Q192D, Q38H/I41S/D60bT/F60eS/
Y60gW/F97G/Ins97aV/T98P/F99L/C122S/Q175L/Q192D,
Q38H/I41S/D60bT/F60eS/Y60gW/F97G/Ins97aV/T98P/
F99L/C122S/G151H/Q175 L/Q192D, Q38H/I41S/D60bT/
F60eS/Y60gW/D96K/T98P/F99L/C122S/Q175L/Q192 D,
Q38H/I41S/D60bT/F60eS/Y60gW/D96K/T98P/F99L/
C122S/G151H/Q175L/Q192 D, Q38H/I41S/D60bT/F60eS/
Y60gW/D96K/Ins97aV/T98P/F99L/C122S/Q175L/
Q192D, Q38H/I41S/D60bT/F60eS/Y60gW/D96K/
Ins97aV/T98P/F99L/C122S/G151H/Q1 75L/Q192D,
Q38H/I41S/D60bT/F60eS/Y60gW/D96K/F97G/T98P/
F99L/C122S/Q17 5L/Q192D, Q38H/I41S/D60bT/F60eS/
Y60gW/D96K/F97G/T98P/F99L/C122S/G151 H/Q175L/
Q192D, Q38H/I41S/D60bT/F60eS/Y60gW/D96K/F97G/
Ins97aV/T98P/F99 L/C122S/Q175L/Q192D, Q38H/I41S/
D60bT/F60eS/Y60gW/D96K/F97G/Ins97aV/T9 8P/F99L/
C122S/G151H/Q175L/Q192D, and the same modifications
except C122S is not modified and is C122C.

Other exemplary modified MTSP-1 polypeptides can contain replacements, insertions and/or deletions corresponding to:
Q38H/I41S/D60bT/F60eS/Y60gW/D96K/F97G/ins97aV/
T98P/F99L/C122S/G151H/Q175L/Q192D or Q38H/I41S/
D60bT/F60eS/Y60gW/D96K/F97G/ins97aV/T98P/F99L/
G151H/Q175L/Q192D, including those in which the unmodified MTSP-1 polypeptide comprises or is the protease domain of SEQ ID NO:2 or SEQ ID NO:4. Other such exemplary modified MTSP-1 polypeptides include, but are not limited to: modified MTSP-1 polypeptides comprising modifications selected from among combinations of modifications in which the protease domain cleaves human C3 in vitro with an $EC_{50}$ of less than 10 nM:
ins97aA/F97G/T98L/C122S/Q175M/Q192A/D217I/
K224R, Q38Y/I41S/D60bT/F60eR/Y60gW/D96M/F97N/
T98G/F99L/C122S/G151N/Q175L, Q38H/I41A/D60bV/
F60eR/Y60gW/D96P/ins97aN/F97W/T98G/F99L/C122S/
G151H/Q175L/Q192E, Q38G/H40R/I41H/D60bN/F97D/
F99L/C122S/Q175L/Q192G, Q38Y/I41S/D60bT/F60eR/
Y60gW/D96M/F97N/T98G/F99L/C122S/G151N/Q175L,
Q38H/I41A/D60bV/F60eR/Y60gW/D96P/ins97aN/F97W/
T98G/F99L/C122S/G151H/Q175L/Q192E, Q38H/I41S/
D60bT/F60eS/Y60gW/D96F/F97D/ins97aE/T98S/F99L/
C122S/G151H/Q175L/Q192A, Q38F/I41A/D60bT/F60eG/
Y60gW/ins97aE/F97T/T98G/F99L/C122S/Q175L/Q192E,
Q38H/I41S/D60bT/F60eS/Y60gW/ins97aV/F97D/T98P/
F99L/C122S/G151H/Q175L, Q38H/I41A/D60bV/F60eT/
Y60gW/ins97aE/F97T/T98G/F99L/C122S/Q175L/Q192E,
Q38H/I41S/D60bT/F60eS/Y60gW/D96K/F97G/ins97aA/
T98P/F99L/C122S/G151H/Q175L/Q192D, Q38H/I41S/
D60bT/F60eS/Y60gW/D96K/F97G/ins97aV/T98P/F99L/
C122S/G151H/Q175L, Q38H/I41A/D60bV/F60eR/
Y60gW/D96P/ins97aN/F97W/T98G/F99L/C122S/G151N/
Q175L/Q192E, Q38Y/I41A/D60bL/F60eQ/ins97aV/F97D/
T98P/F99L/C122S/G151N/Q175M/Q192A, Q38H/I41S/
D60bF/F60 eV/F97D/ins97aV/T98P/F99L/C122S/G151N/
Q175L/Q192A, Q38H/I41A/D60bV/F60eA/Y60gW/F97T/
ins97aE/T98G/F99L/C122S/Q175L/Q192V, Q38H/I41A/
D60bV/F60eR/Y60gW/D96I/ins97aN/F97Y/T98G/F99L/
C122S/G151H/Q175L/Q192D, Q38H/I41S/D60bT/F60eS/
Y60gW/D96L/ins97aG/F97D/T98N/F99L/C122S/G151H/
Q175L/Q192E, Q38H/I41A/D60bV/F60eR/Y60gW/D96P/
ins97aN/F97W/T98G/F99L/C122S/G151H/Q175L/Q192D,
Q38F/I41S/D60bF/F60eR/Y60gF/F97T/ins97aE/T98G/
F99L/C122S/G151N/Q175L/Q192V, Q38H/I41S/D60bY/
D96Y/ins97aV/F97D/T98P/F99L/L106M/C122S/I136M/
Q192G/Q209L/D217T, Q38H/I41A/D60bV/F60eR/
Y60gW/D96S/ins97aR/F97A/T98S/F99L/C122S/G151N/
Q175L/Q192T, Q38H/I41A/D60bV/F60eR/Y60gW/D96I/
ins97aN/F97Y/T98G/F99L/C122S/G151N/Q175L/Q192D,
Q38H/I41A/D60bT/F60eH/Y60gW/ins97aE/F97T/T98G/
F99L/C122S/Q175L/Q192D, Q38H/I41A/D60bV/F60eR/
Y60gW/ins97aE/F97T/T98G/F99L/C122S/Q175L/Q192D,
ins97aY/F97G/T98V/C122S/Q175M/Q192S/D217V,
Q38H/I41S/D60bS/ins97aV/F97D/T98P/F99L/M117L/
C122S/I136T/Q192G/D217I, Q38H/I41A/D60bV/F60eR/
Y60gW/D96I/F97N/T98G/F99L/C122S/G151H/Q175L/
Q192D, Q38H/I41A/D60bV/F60eR/Y60gW/D96P/
ins97aN/F97W/T98G/F99L/C122S/G151N/Q175L/Q192D,
Q38H/I41A/D60bT/F60eK/Y60gW/F97T/ins97aE/T98G/
F99L/C122S/Q175L/Q192A, H40R/I41H/F97D/F99L/
C122S/Q175M/Q192G/D217V/K224Y, I41G/F97I/F99L/
C122S/G151L/Q175M/Q192S/D217V, Q38H/I41S/D60bT/
F60eS/Y60gW/D96V/F97G/ins97aV/T98P/F99L/C122S/
G151H/Q175L/Q192D, Q38H/I41A/D60bV/F60eR/
Y60gW/D96I/F97N/T98G/F99L/C122S/G151N/Q175L/
Q192D, Q38H/I41S/D60bT/F60eS/Y60gW/D96K/F97G/
ins97aV/T98P/F99L/C122S/T150S/G151H/Q175L/Q192D/
Q209L, Q38H/I41A/D60bV/F60eI/Y60gW/F97T/ins97aE/
T98G/F99L/C122S/G151N/Q175L/Q192D, Q38H/I41S/
D60bT/F60eS/Y60gW/D96I/F97N/T98G/F99L/C122S/
G151N/Q175L/Q192D, Q38H/I41A/D60bW/ins97aV/
F97D/T98P/F99L/C122S/I136M/Q192G/D217N, Q38H/
I41S/D60bF/F60eT/ins97aV/F97D/T98P/F99L/C122S/
H143Q/G151N/Q175L/Q192G, Q38Y/I41S/D60bT/
Y60gW/D96M/F97N/T98G/F99L/C122S/G151N/Q175L/
Q192D, Q38H/I41A/F60eH/Y60gW/ins97aE/F97T/T98G/
F99L/C122S/Q175L/Q192A, I41T/D60bW/F60eH/F97D/ ins97aV/T98P/F99L/C122S/G151N/Q175L/Q192G, Q38H/ I41S/D60bT/F60eS/Y60gW/D96F/F97Y/ins97aD/T98G/ F99L/C122S/G151H/Q175L/Q192D, Q38H/I41A/D60bV/ F60eR/Y60gW/D96F/F97S/ins97aH/T98G/F99L/C122S/ G151N/Q175L/Q192G, Q38H/I41S/D60bT/F60eS/ Y60gW/ins97aV/T98P/F99L/C122S/G151H/Q175L/ Q192E, I41S/F99L/C122S/G151N/Q175M/Q192G/D217V, Q38R/I41S/D60bY/F60eD/ins97aV/F97D/T98P/F99L/ C122S/G151N/Q175M/Q192A, Q38Y/I41S/D60bT/F60eR/ Y60gW/D96M/T98G/F99L/C122S/G151N/Q175L/Q192D, H40R/I41H/Y60gH/F97D/F99L/C122S/Q175M/Q192G/ D217I/K224L, Q38H/I41A/D60bV/F60eR/Y60gW/F97D/ F99L/C122S/G151H/Q175L/Q192D, Q38Y/I41S/D60bT/ F60eR/Y60gW/D96M/F97N/T98G/F99L/C122S/Q175L/ Q192D, Q38H/I41A/D60bV/F60eR/Y60gW/D96F/F97Y/ ins97aN/T98G/F99M/C122S/G151N/Q175 L/Q192G, Q38H/I41S/D60bT/F60eS/Y60gW/D96Y/F97N/ins97aE/ T98S/F99L/C122S/G151H/Q175L/Q192D, Q38H/I41S/ D60bT/F60eS/Y60gW/D96K/F97D/ins97aA/T98P/F99L/ C122S/G151N/Q175L/Q192D, and the same modifications except C122S is not modified and is C122C.

Exemplary of modified MTSP-1 polypeptides provided herein are those that contain or have the sequences set forth in any of SEQ ID NOs.: 6, 8, 21-59 and 63-81. This includes the modified MTSP-1 polypeptide whose sequence is set forth in SEQ ID NO: 35 or in SEQ ID NO: 42. MTSP-1 polypeptides that contain the modifications Q38H/I41S/ D60bT/F60eS/Y60gW/D96K/F97G/ins97aV/T98P/F99L/ C122S/G151H/Q175L/Q192D (with or without the C122S) are exemplary of such polypeptides.

For all of the modified MTSP-1 polypeptides provided herein, the unmodified MTSP-1 polypeptides include those that contain or have the sequence of amino acid residues set forth in SEQ ID NO:2 or 4 (protease domain). Included are full-length, two chain forms, two chain activated forms, and single chain forms that contain the protease domain or a catalytically active portion thereof.

The modified MTSP-1 polypeptides are selected to cleave and inactivate C3 so that, in vivo, complement activation is reduced. Modified MTSP-1 polypeptides provided herein include those that cleave within residues QHARASHL (residues 737-744) of human C3 (SEQ ID NO:9), such as those in which P1-P1' is RA.

All or any of the modified MTSP-1 polypeptides provided herein can include structural modifications and post-translational modifications such as additions of a polymer(s) to increase serum half-life and/or to reduce immunogenicity or both. Structural modifications include alterations in glycosylation, such as addition of glycosylation sites or types of glycosylation, and additions of polymers, such as dextran, sialylation and PEGylation. Any of the modified MTSP-1 polypeptides can be PEGylated to increase half-life and/or serum stability, particularly for indications in which extended duration of action is desired. The modified MTSP-1 polypeptide can be further modified, such as by addition or elimination of lysines or other residues to alter PEGylation or by addition of or elimination of glycosylation sites.

Also, provided are fusion proteins, containing a modified MTSP-1 polypeptide or a catalytically active portion of a modified MTSP-1 polypeptide provided herein fused or otherwise conjugated via a chemical or physical linker or bond to a non-MTSP-1 protease polypeptide or a portion thereof. Exemplary of such non-protease polypeptides is a multimerization domain, such as an Fc domain, or a protein transduction domain (PTD).

Also provided are nucleic acid molecules encoding any of the modified MTSP-1 polypeptides and fusion proteins provided herein. Vectors containing the nucleic acid molecules also are provided. The vectors can be prokaryotic vectors or eukaryotic vectors, and include expression vectors, viral vectors, and vectors for gene therapy. Viral vectors include, but are not limited to, a herpes virus simplex vector, or a vaccinia virus vector, or an adenoviral vector, or a retroviral vector, or an insect vector.

Provided are isolated cells, isolated non-human cells (that cannot develop into a zygote or into a human by any method available to those of skill in the art) and cell cultures that contain the nucleic acid molecule or nucleic acid molecules or vectors encoding the modified MTSP-1 polypeptides provided herein. Methods for making the modified MTSP-1 polypeptides are provided, and include amino acid synthesis methods, and recombinant DNA methods. These include introducing a nucleic acid or vector encoding a modified MTSP-1 polypeptide provided herein into a cell; culturing the cell under conditions, whereby the polypeptide is expressed; and optionally, isolating or purifying the expressed modified MTSP-1 polypeptide. Cells include any suitable cells or cell lines, including eukaryotic cells or prokaryotic cells. These include bacterial cells, mammalian cells, and yeast cells. For example, the cell can be a CHO cell, a BHK cell, *saccharomyces*, *Pichia* and such mammalian cells. Cells and methods for producing recombinant therapeutic polypeptides are well known to those of skill in the art.

The nucleic acids, vectors and polypeptides can be used for treating or in methods of a disease or condition mediated by or involving complement activation, wherein inhibition of complement activation effects treatment or amelioration of the disease or condition. The nucleic acids and vectors can be used for gene therapy, or the polypeptides can be administered. Suitable routes of administration include parenteral, local, systemic and transdermal routes. These include intravenous, intramuscular, subcutaneous, and intravitreal administration.

Provided are methods of treating a disease or condition mediated by or involving complement activation where inhibition or reduction of activation effects treatment or some amelioration of symptoms or prevents (reduces the risk) of such disease or condition. The nucleic acid or vector or polypeptide is administered to a subject to treat or prevent (reduce the risk or symptoms) of the disease or condition. Complement-mediated diseases or disorders or conditions include, but are not limited to, inflammatory disease and conditions, sepsis, rheumatoid arthritis (RA), an ophthalmic or ocular disease, a cardiovascular disease, membranoproliferative glomerulonephritis (MPGN), ophthalmic or ocular diseases or disorders, multiple sclerosis (MS), myasthenia gravis (MG), asthma, inflammatory bowel disease, immune complex (IC)-mediated acute inflammatory tissue injury, Alzheimer's Disease (AD), transplanted organ rejection, and ischemia-reperfusion injury.

The disease or condition can be an ocular or ophthalmic disease or rejection or inflammation due to a transplanted organ. Exemplary of such diseases, disorders or conditions is a diabetic retinopathy or a macular degeneration, including age-related macular degeneration (AMD) and delayed renal graft function (DGF).

The polypeptides provided herein can be used for inhibiting complement activation by contacting a modified MTSP-1 polypeptide with a complement protein C3, whereby complement protein C3 is cleaved such that complement activation is reduced or inhibited. The subjects for treatment with the polypeptides, methods and uses herein can be any animal, including humans, and domesticated animals, particularly, dogs, cats and other pets and farm animals. Inhibition of complement activation can reduce the risk of developing (prevent) a disease, condition or disorder or lessen the disease, condition or disorder if it develops, or treat the disease or disorder or condition. Inhibition of complement activation, among its effects, leads to a reduction of inflammatory symptoms associated with a complement-mediated disease or disorder selected from among an inflammatory disorder, a neurodegenerative disorder and a cardiovascular disorder. As noted above, complement-mediated diseases or disorders or conditions include, but are not limited to, sepsis, Rheumatoid arthritis (RA), ocular or ophthalmic disorders, membranoproliferative glomerulonephritis (MPGN), Multiple Sclerosis (MS), delayed rejection of or inflammation of transplanted organs or tissues, Myasthenia gravis (MG), asthma, inflammatory bowel disease, immune complex (IC)-mediated acute inflammatory tissue injury, Alzheimer's Disease (AD), and Ischemia-reperfusion injury, and any others known to those of skill in the art.

The complement-mediated disease, condition or disorder can result from a treatment of a subject. For example, ischemia-reperfusion injury can be caused by an event or treatment selected from among myocardial infarct (MI), stroke, angioplasty, coronary artery bypass graft, cardiopulmonary bypass (CPB), and hemodialysis. Treatment with a modified MTSP-1 polypeptide provided herein can be effected prior to a treatment of a subject that results in or has risk of causing a complement mediated disorder, condition or disease.

Provided are uses of the modified MTSP-1 polypeptides provided herein and methods of treating a disease or condition mediated by or involving complement activation, by administering a modified MTSP-1 polypeptide provided herein, where inhibition of complement activation effects treatment or amelioration of the disease or condition. The modified MTSP-1 polypeptides also can be administered to reduce the risk (prevent) of a developing a disease or condition or to reduce the symptoms of such disease, disorder or condition development. Complement-mediated diseases, conditions or disorders include any noted above or below. Included are ocular or ophthalmic diseases or rejection of or inflammation due to a transplanted organ. Such diseases and conditions include diabetic retinopathy and a macular degeneration, such as AMD, and delayed renal graft function (DGF). The modified MTSP-1 polypeptide (or encoding nucleic acid molecule or vector) can be administered by any suitable route, including those discussed above and elsewhere herein, such as parenterally, such as administered intravenously, or subcutaneously. For treatment of ophthalmic disorders the modified MTSP-1 polypeptides can be administered locally, such as by intravitreal injection or by topical application to the eye. The modified MTSP-1 polypeptide can be modified for introduction into the eye, such as by fusion to a protein transduction domain to facilitate transduction into the vitreous humor. For any application, method or use, the modified MTSP-1 polypeptide can be modified to increase serum half-life, such as by PEGylation.

Also provided are combinations and kits, that include: (a) a modified MTSP-1 polypeptide provided herein; and (b) a second agent or agents for treating a complement-mediated disease or disorder. Second agents include, but are not limited to anti-inflammatory agent(s) and anticoagulant(s), such as, but not limited to, any one or more of a non-steroidal anti-inflammatory drug (NSAID), antimetabolite, corticosteroid, analgesic, cytotoxic agent, pro-inflammatory cytokine inhibitor, anti-inflammatory cytokines, B cell targeting agents, compounds targeting T antigens, adhesion molecule blockers, chemokine receptor antagonists, kinase inhibitors, PPAR-γ (gamma) ligands, complement inhibitors, heparin, warfarin, acenocoumarol, phenindione, EDTA, citrate, oxalate, argatroban, lepirudin, bivalirudin, and ximelagatran.

The methods, uses or combinations include those in which the modified MTSP-1 polypeptide comprises the modification I41D or I41S, particularly I41S, and particularly modified MTSP-1 polypeptides containing the modifications Q38H/I41S/D60bT/F60eS/Y60gW/D96K/F97G/ins97aV/T98P/F99L/C122S/G151H/Q175L/Q192D, or Q38H/I41S/D60bT/F60eS/Y60gW/D96K/F97G/ins97aV/T98P/F99L/G151H/Q175L/Q192D Q38H/I41S/D60bT/F60eS/Y60gW/D96K/F97G/ins97aV/T98P/F99L/G151H/Q175L/Q192D or I41D/C122S/G151N/Q192T or I41D/G151N/Q192T. The replacement C122S (with reference to the protease domain) is included to eliminate a free cysteine to reduce aggregation. The unmodified MTSP-1 polypeptide includes the protease domain, such as that of sequence of amino acid residues set forth in SEQ ID NO:4, such as a modified MTSP-1 polypeptide that contains the sequence of amino acid residues set forth in any of SEQ ID NOs:35 and 42.

Provided are methods of treating DGF by intravenously administering a modified MTSP-1 polypeptide provided herein, such as a modified MTSP-1 polypeptide that contains the sequence of amino acid residues set forth in any of SEQ ID NOs:35 and 42 or a catalytically active portion thereof, such as a modified MTSP-1 polypeptide that comprises the replacements Q38H/I41S/D60bT/F60eS/Y60gW/D96K/F97G/ins97aV/T98P/F99L/C122S/G151H/Q175L/Q192D. Dosages include any suitable dose and any suitable dosage regimen. A single dosage includes 0.1 mg to 1 mg. Treatment can be once or can be repeated a plurality of times, such as every 2 days, 3 days, 4 days, 5 days, 6 days, weekly, bi-weekly or monthly. The modified MTSP-1 polypeptides can be modified, such as by PEGylation or multimerization to effect increased half-life or increased bioavailability.

Provided are uses of the modified MTSP-1 polypeptides and/or methods of treating an ophthalmic disorder or ocular disorder, by administering a modified MTSP-1 polypeptide provided herein such as systemically or to the eye. Ophthalmic disorders include diabetic retinopathy and macular degeneration, such as AMD. Suitable dosages can be empirically determined, and include a single dosage that is 0.1 to 1 mg. Exemplary of modified MTSP-1 polypeptides for use for these indications are any provided herein that cleave C3. These include modified MTSP-1 polypeptides that contains the sequence of amino acid residues set forth in any of SEQ ID NOs:35 and 42 or a catalytically active portion thereof, such as, but are not limited to, a modified MTSP-1 polypeptide that comprises the replacements, or insertions and/or deletions:
Q38H/I41S/D60bT/F60eS/Y60gW/D96K/F97G/ins97aV/T98P/F99L/C122S/G151H/Q175L/Q192D or Q38H/I41S/D60bT/F60eS/Y60gW/D96K/F97G/ins97aV/T98P/F99L/G151H/Q175L/Q192D
or the modified MTSP-1 polypeptide comprises the replacements:
I41D/G151N/Q192T or I41D/C122S/G151N/Q192T. The polypeptides can be administered to the eye as described above, such as by intravitreal injection or other local method. Treatment can be once or repeated a plurality of times, such as every 2 days, 3 days, 4 days, 5 days, 6 days, weekly, bi-weekly or monthly. The modified MTSP-1 polypeptides include those of SEQ ID NO:35 or a catalytically active portion thereof or full-length forms or catalytically active portions thereof. The modified MTSP-1 polypeptides can be modified, such as by PEGylation or multimerization to effect increased half-life or increased bioavailability.

For any application, the modified MTSP-1 polypeptide can be a single chain or two chain form of the modified MTSP-1 polypeptide or a zymogen form that is activated in vivo. The protease domains are active as single chains. The modified MTSP-1 polypeptides can include other modifications, such as PEGylation to alter or improve pharmacological properties.

BRIEF DESCRIPTION OF THE DRAWINGS

FIG. 2 provides a table that provides the C3 activity (as an $ED_{50}$) to deconvolute the effect of each mutation on C3 activity in the modified MTSP-1 polypeptide that contains the modifications Q38H/I41S/D60bT/F60eS/Y60gW/D96K/F97G/ins97aV/ T98P/F99L/C122S/G151H/Q175L/Q192D (see SEQ ID NO:35), measured in vitro. Modified MTSP-1 polypeptides contain each of the modifications except for the one modification whose effect on C3 activity is assessed. Cells in the table with thick borders indicate that the modified MTSP-1 polypeptides are the wild-type MTSP-1 protease domain residues set forth in SEQ ID NO:4. Cells with thin borders indicate that the modified MTSP-1 polypeptides contain the same amino acid as the MTSP-1 protease domain set forth in SEQ ID NO:35.

DETAILED DESCRIPTION

Figure 1:
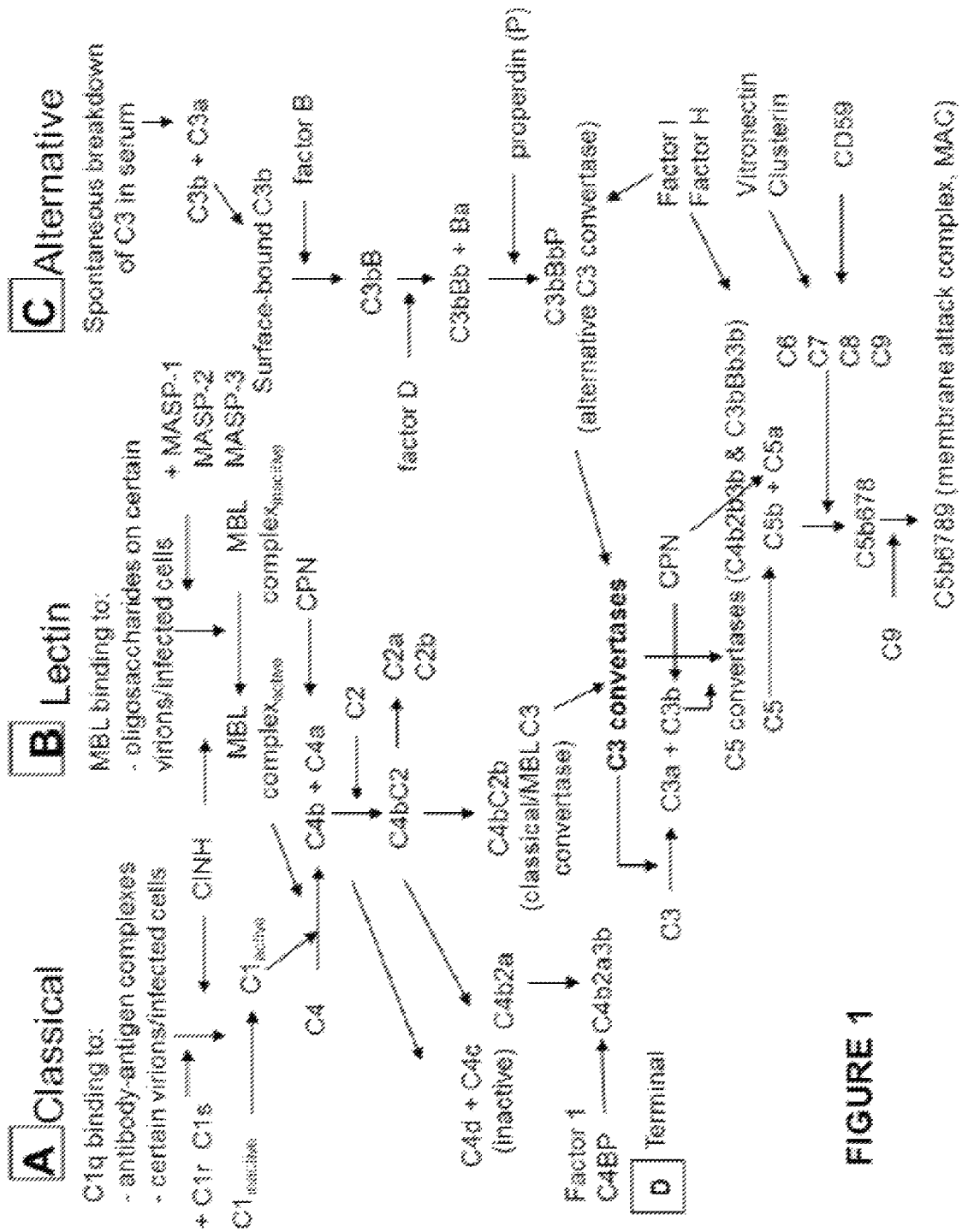
FIG. 1 depicts an overview of the classical, lectin, and alternative complement pathways and the activation of the terminal complement complex, the membrane attack complex (MAC). The FIGURE depicts many of the more than 30 proteins that participate in the complement cascade, their action within the cascade, and where applicable, their points of convergence among the complement pathways. For example, the three pathways converge upon the generation of a C3 convertase, which cleaves C3 to form a C5 convertase yielding the formation of the MAC complex. The FIGURE also depicts the generation of many of the complement cleavage products.

Outline
A. DEFINITIONS
B. MTSP-1 STRUCTURE AND FUNCTION
   1. Serine Proteases
   2. Structure
   3. Function/Activity
C. COMPLEMENT INHIBITION BY TARGETING C3
   1. Complement Protein C3 and its Role in Initiating Complement
      a. Classical Pathway
      b. Alternative Pathway
      c. Lectin Pathway
      d. Complement-Mediated Effector Functions
   i. Complement-Mediated Lysis: Membrane Attack Complex
   ii. Inflammation
   iii. Chemotaxis
   iv. Opsonization
   v. Activation of the Humoral Immune Response
   2. C3 Structure and Function
      a. C3a
      b. C3b
         i. Inhibitors of C3b
D. MODIFIED MTSP-1 POLYPEPTIDES THAT CLEAVE C3
   1. Exemplary Modified MTSP-1 Polypeptides
   2. Additional Modifications
      a. Decreased Immunogenicity
      b. Fc Domains
      c. Conjugation to Polymers
      d. Protein Transduction Domains
E. ASSAYS TO ASSESS AND/OR MONITOR MTSP-1 ACTIVITY ON COMPLEMENT-MEDIATED FUNCTIONS
   1. Methods for Assessing MTSP-1 Activity and Specificity for Cleaving Complement Protein C3 to Inactivate it
      a. Protein Detection
         i. SDS-PAGE Analysis
         ii. Enzyme Immunoassay
         iii. Radial Immunodiffusion (RID)
      b. Hemolytic Assays
      c. Methods for Determining Cleavage Sites
   2. Methods for Assessing Wild Type MTSP-1 Activity
      a. Cleavage of MTSP-1 Substrates
      b. MTSP-1—Substrate Binding Assays
      c. C3 Cleavage Assays
   3. Specificity
   4. Disease Models
F. METHODS OF PRODUCING NUCLEIC ACIDS ENCODING MODIFIED MTSP-1 POLYPEPTIDES
   1. Isolation or Preparation of Nucleic Acids Encoding MTSP-1 Polypeptides
   2. Generation of Mutant or Modified Nucleic Acids and Encoding Polypeptides
   3. Vectors and Cells
   4. Expression
      a. Prokaryotic Cells
      b. Yeast Cells
      c. Insects and Insect Cells
      d. Mammalian Expression
      e. Plants
   5. Purification
   6. Additional Modifications
      a. PEGylation
      b. Fusion Proteins
   7. Nucleic Acid Molecules
G. COMPOSITIONS, FORMULATIONS AND DOSAGES
   1. Administration of Modified MTSP-1 Polypeptides
   2. Administration of Nucleic Acids Encoding Modified MTSP-1 Polypeptides (Gene Therapy)
H. THERAPEUTIC USES AND METHODS OF TREATMENT
   1. Disease Mediated by Complement Activation
      a. Rheumatoid Arthritis
      b. Sepsis
      c. Multiple Sclerosis
      d. Alzheimer's Disease
      e. Ischemia-Reperfusion Injury
      f. Ocular Disorders
         Age-Related Macular Degeneration (AMD)
      g. Organ Transplantation and Delayed Graft Function (DGF)
   2. Therapeutic Uses
      a. Immune-Mediated Inflammatory Diseases
      b. Neurodegenerative Disease c. Cardiovascular Disease
d. Age-Related Macular Degeneration (AMD)
e. Organ Transplant
   Delayed Graft Function
3. Combination Therapies
I. EXAMPLES

A. DEFINITIONS

Unless defined otherwise, all technical and scientific terms used herein have the same meaning as is commonly understood by one of skill in the art to which the invention(s) belong. All patents, patent applications, published applications and publications, GENBANK sequences, websites and other published materials referred to throughout the entire disclosure herein, unless noted otherwise, are incorporated by reference in their entirety. In the event that there is a plurality of definitions for terms herein, those in this section prevail. Where reference is made to a URL or other such identifier or address, it is understood that such identifiers can change and particular information on the internet can come and go, but equivalent information is known and can be readily accessed, such as by searching the internet and/or appropriate databases. Reference thereto evidences the availability and public dissemination of such information.

As used herein, cleavage refers to the breaking of peptide bonds by a protease. The cleavage site motif for a protease involves residues N- and C-terminal to the scissile bond (the unprimed and primed sides, respectively, with the cleavage site for a protease defined as . . . P3-P2-P1-P1'-P2'-P3' . . . , and cleavage occurs between the P1 and P1' residues). In human C3, cleavage by a C3 convertase occurs between residues R and S (see residues 746-751 of SEQ ID NO: 9, cleavage between residue 748 and 749 of the sequence in human C3) of C3:

| P3 | P2 | P1 | | P1' | P2' | P3' |
|----|----|----|----|-----|-----|-----|
| Leu | Ala | Arg | ↓ | Ser | Asn | Leu. |

Typically, cleavage of a substrate in a biochemical pathway is an activating cleavage or an inhibitory cleavage. An activating cleavage refers to cleavage of a polypeptide from an inactive form to an active form. This includes, for example, cleavage of a zymogen to an active enzyme. An activating cleavage also is cleavage whereby a protein is cleaved into one or more proteins that themselves have activity. For example, the complement system is an irreversible cascade of proteolytic cleavage events whose termination results in the formation of multiple effector molecules that stimulate inflammation, facilitate antigen phagocytosis, and lyse some cells directly. Thus, cleavage of C3 by a C3 convertase into C3a and C3b is an activation cleavage. In contrast, the modified MTSP-1 polypeptides provided herein effect inhibitory cleavage of C3, such as by cleavage in a target site that inactivates C3.

As used herein, an inhibitory cleavage or inactivation cleavage is cleavage of a protein into one or more degradation products that are not functional. Inhibitory cleavage results in the diminishment or reduction of an activity of a protein. Typically, a reduction of an activity of a protein reduces the pathway or process for which the protein is involved. In one example, the cleavage of any one or more complement proteins that is an inhibitory cleavage results in the concomitant reduction or inhibition of any one or more of the classical, lectin, or alternative functional pathways of complement. To be inhibitory, the cleavage reduces activity by at least or at least about 1%, 2%, 5%, 10%, 20%, 30%, 40%, 50%, 60%, 70%, 80%, 90%, 95%, 99% or more compared to a native form of the protein. The percent cleavage of a protein that is required for the cleavage to be inhibitory varies among proteins but can be determined by assaying for an activity of the protein.

As used herein, "complement activation" refers to the activation of complement pathways, for example complement activation refers to an increase in the functions or activities of any one or more of the complement pathways by a protease or an increase in the activity of any of the proteins in the complement pathway. Complement activation can lead to complement-mediated cell lysis or can lead to cell or tissue destruction. Inappropriate complement activation on host tissue plays an important role in the pathology of many autoimmune and inflammatory diseases, and also is responsible for or associated with many disease states associated with bioincompatibility. It is understood that activation can mean an increase in existing activity as well as the induction of a new activity. A complement activation can occur in vitro or in vivo. Exemplary functions of complement that can be assayed and that are described herein include hemolytic assays, and assays to measure any one or more of the complement effector molecules such as by SDS PAGE followed by Western Blot or Coomassie Brilliant Blue staining or by ELISA. In some embodiments, complement activation is inhibited by a protease, such as a protease described herein, by 40%, 50%, 60%, 70%, 80%, 85%, 90%, 95% or 99% or more compared to the activity of complement in the absence of a protease.

As used herein, "inhibiting complement activation" or "complement inactivation" refers to the reduction or decrease of a complement-mediated function or activity of any one or more of the complement pathways by a protease or in the activity of any of the proteins in a pathway. A function or activity of complement can occur in vitro or in vivo. Exemplary functions of complement that can be assayed and that are described herein include hemolytic assays, and assays to measure any one or more of the complement effector molecules such as by SDS PAGE followed by Western Blot or Coomassie Brilliant Blue staining or by ELISA. A protease can inhibit complement activation by 1%, 5%, 10%, 20%, 30%, 40%, 50%, 60%, 70%, 80%, 90% or more. In other embodiments, complement activation is inhibited by a protease by 40%, 50%, 60%, 70%, 80%, 85%, 90%, 95% or 99% or more compared to the activity of complement in the absence of a protease.

As used herein, a "complement protein" or a "complement component" is a protein of the complement system that functions in the host's defense against infections and in the inflammatory process. Complement proteins include those that function in the classical pathway, those that function in the alternative pathway, and those that function in the lectin pathway. Among the complement proteins are proteases that participate in the complement pathways. In addition, as used herein, complement proteins include any of the "cleavage products" (also referred to as "fragments") that are formed upon activation of the complement cascade. Also included among complement proteins are inactive or altered forms of complement proteins, such as iC3b and C3a-desArg. Thus, complement proteins include, but are not limited to: C1q, C1r, C1s, C2, C3, C3a, C3b, C3c, C3dg, C3g, C3d, C3f, iC3, C3a-desArg, C4, C4a, C4b, iC4, C4a-desArg, C5, C5a, C5a-des-Arg, C6, C7, C8, C9, MASP-1, MASP-2, MBL, Factor B, Factor D, Factor H, Factor I, CR1, CR2, CR3, CR4, properdin, C1Inh, C4 bp, MCP, DAF, CD59 (MIRL), clusterin and HRF and allelic and species variants of any complement protein.

As used herein, a "native" form of a complement protein is one which can be isolated from an organism such as a vertebrate in the absence of complement activation, and which has not been intentionally modified by man in the laboratory. Examples of native complement proteins include C1q, C1r, C1s, C2, C3, C4, Factor B, Factor D, properdin, C5, C6, C7, C6, and C9.

Generally, "native complement proteins" are inactive and acquire activity upon activation. Activation can require activation cleavage, maturation cleavage and/or complex formation with other proteins. An exception to this is Factor I and Factor D which have enzymatic activity in their native form. In some examples, activation of a native complement protein occurs following cleavage of the protein. For example, complement zymogens such as C3 are proteases which are themselves activated by protease cleavage such that cleavage of C3 by the C3 convertase C4b2b generates the active fragments C3a and C3b. In another example, cleavage of an inactive native complement protein results in changes in the structural stability of a protein resulting in activation of the protein. For example, C3 contains an internal thioester bond which in the native protein is stable, but can become highly reactive and activated following conformational changes that result from cleavage of the protein. Thus, the cleavage products of C3 are biologically active. Activation of C3 also can occur spontaneously in the absence of cleavage. It is the spontaneous conversion of the thioester bond in native C3 that is an initiating event of the alternative pathway of complement. In other examples, activation of a native complement protein occurs following the release of a complexed regulatory molecule that inhibits the activity of an otherwise active native complement protein. For example, C1inh binds to and inactivates C1s and C1r, unless they are in complex with C1q.

As used herein, "maturation cleavage" is a general term that refers to any cleavage required for activation of a zymogen. This includes cleavage that leads to a conformational change resulting in activity (i.e., activation cleavage). It also includes cleavage in which a critical binding site is exposed or a steric hindrance is exposed or an inhibitory segment is removed or moved.

As used herein, "altered form" of a complement protein refers to a complement protein that is present in a non-native form resulting from modifications in its molecular structure. For example, C3 reaction of the thioester with water can occur in the absence of convertase cleavage, giving a hydrolyzed inactive form of C3 termed iC3. In another example, anaphylatoxins including C3a, C5a, and C4a can be desarginated by carboxypeptidase N into more stable, less active forms.

As used herein, a "fragment" or "cleavage product" of a complement protein is a region or segment of a complement protein that contains a portion of the polypeptide sequence of a native complement protein. A fragment of a complement protein usually results following the activation of a complement cascade. Generally, a fragment results from the proteolytic cleavage of a native complement protein. For example, complement protein C3 is enzymatically cleaved by a C3 convertase, resulting in two fragments: C3a which constitutes the N-terminal portion of C3; and C3b which constitutes the C-terminal portion and contains the serine protease site. A fragment of a complement protein also results from the proteolytic cleavage of another fragment of a complement protein. For example, C3b, a fragment generated from the cleavage of C3, is cleaved by Factor I to generate the fragments iC3b and C3f. Generally cleavage products of complement proteins are biologically active products and function as cleavage effector molecules of the complement system. Hence a fragment or portion of complement protein includes cleavage products of complement proteins and also portions of the proteins that retain or exhibit at least one activity of a complement protein.

As used herein, "cleavage effector molecules" or "cleavage effector proteins" refers to the active cleavage products generated as a result of the triggered-enzyme cascade of the complement system. A cleavage effector molecule, a fragment or a cleavage product resulting from complement activation can contribute to any of one or more of the complement-mediated functions or activities, which include opsonization, anaphylaxis, cell lysis and inflammation. Examples of cleavage or effector molecules include, but are not limited to, C3a, C3b, C4a, C4b, C5a, C5b-9, and Bb. Cleavage effector molecules of the complement system, by virtue of participation in the cascade, exhibit activities that include stimulating inflammation, facilitating antigen phagocytosis, and lysing some cells directly. Complement cleavage products promote or participate in the activation of the complement pathways.

As used herein, "anaphylatoxins" are cleavage effector proteins that trigger degranulation of, or release of substances from, mast cells or basophils, which participate in the inflammatory response, particularly as part of defense against parasites. If the degranulation is too strong, it can cause allergic reactions. Anaphylatoxins include, for example, C3a, C4a and C5a. Anaphylatoxins also indirectly mediate spasms of smooth muscle cells (such as bronchospasms), increases in permeability of blood capillaries, and chemotaxis.

As used herein, "chemotaxis" refers to receptor-mediated movement of leukocytes towards a chemoattractant typically in the direction of the increasing concentration thereof, such as in the direction of increasing concentration of an anaphylatoxin.

As used herein, "opsonization" refers to the alteration of the surface of a pathogen or other particle so that it can be ingested by phagocytes. A protein that binds or alters the surface of a pathogen is termed an opsonin. Antibody and complement proteins opsonize extracellular bacteria for uptake and destruction by phagocytes such as neutrophils and macrophages.

As used herein, "cell lysis" refers to the breaking open of a cell by the destruction of its wall or membrane. Hemolysis of red blood cells is a measure of cell lysis.

As used herein, "complement protein C3" or "C3" refers to complement protein C3 of the complement system that functions in the host defense against infections and in the inflammatory process. Human complement protein C3 is a 1663 amino acid single-chain pre-proprotein or zymogen set forth in SEQ ID NO: 9 that that contains a 22 amino acid signal peptide (amino acids 1-22 of SEQ ID NO: 9) and a tetra-arginine sequence (amino acids 668-671 of SEQ ID NO: 9) that is removed by a furin-like enzyme resulting in a mature two chain protein containing a beta chain (amino acids 23-667 of SEQ ID NO: 9) and an alpha chain (amino acids 672-1663 of SEQ ID NO:9) linked by a disulfide bond between residues C559 and C816. Complement protein C3 is further activated by proteolytic cleavage by a C3 convertase (C4b2b or C3bBb) between amino acids 748 and 749 of SEQ ID NO: 9 generating the anaphylatoxin C3a and the opsonin C3b.

As used herein, a "zymogen" refers to a protein that is activated by proteolytic cleavage, including maturation cleavage, such as activation cleavage, and/or complex formation with other protein(s) and/or cofactor(s). A zymogen is an inactive precursor of a protein. Such precursors are generally larger, although not necessarily larger, than the active form. With reference to MTSP-1 or complement protein C3, zymogens are converted to active enzymes by specific cleavage, including catalytic and autocatalytic cleavage, or by binding of an activating co-factor, which generates an active enzyme. A zymogen, thus, is an enzymatically inactive protein that is converted to a proteolytic enzyme by the action of an activator. Cleavage can be effected autocatalytically. A number of complement proteins are zymogens; they are inactive, but become cleaved and activated upon the initiation of the complement system following infection. Zymogens, generally, are inactive and can be converted to mature active polypeptides by catalytic or autocatalytic cleavage of the proregion from the zymogen.

As used herein, a "proregion," "propeptide," or "pro sequence," refers to a region or a segment of a protein that is cleaved to produce a mature protein. This can include segments that function to suppress enzymatic activity by masking the catalytic machinery and thus preventing formation of the catalytic intermediate (i.e., by sterically occluding the substrate binding site). A proregion is a sequence of amino acids positioned at the amino terminus of a mature biologically active polypeptide and can be as little as a few amino acids or can be a multidomain structure.

As used herein, an "activation sequence" refers to a sequence of amino acids in a zymogen that is the site required for activation cleavage or maturation cleavage to form an active protease. Cleavage of an activation sequence can be catalyzed autocatalytically or by activating partners.

Activation cleavage is a type of maturation cleavage in which a conformational change required for activity occurs. This is a classical activation pathway, for example, for serine proteases in which a cleavage generates a new N-terminus which interacts with the conserved regions of catalytic machinery, such as catalytic residues, to induce conformational changes required for activity. Activation can result in production of multi-chain forms of the proteases. In some instances, single chain forms of the protease can exhibit proteolytic activity.

As used herein, "domain" refers to a portion of a molecule, such as proteins or the encoding nucleic acids, that is structurally and/or functionally distinct from other portions of the molecule and is identifiable. An exemplary polypeptide domain is a part of the polypeptide that can form an independently folded structure within a polypeptide made up of one or more structural motifs (e.g., combinations of alpha helices and/or beta strands connected by loop regions) and/or that is recognized by a particular functional activity, such as enzymatic activity, dimerization or substrate-binding. A polypeptide can have one or more, typically more than one, distinct domains. For example, the polypeptide can have one or more structural domains and one or more functional domains. A single polypeptide domain can be distinguished based on structure and function. A domain can encompass a contiguous linear sequence of amino acids. Alternatively, a domain can encompass a plurality of non-contiguous amino acid portions, which are non-contiguous along the linear sequence of amino acids of the polypeptide. Typically, a polypeptide contains a plurality of the domains. For example, serine proteases can be characterized based on the sequence of protease domain(s). Those of skill in the art are familiar with polypeptide domains and can identify them by virtue of structural and/or functional homology with other such domains. For exemplification herein, definitions are provided, but it is understood that it is well within the skill in the art to recognize particular domains by name. If needed, appropriate software can be employed to identify domains.

As used herein, a "structural region" of a polypeptide is a region of the polypeptide that contains at least one structural domain.

As used herein, a "protease domain" is the catalytically active portion of a protease. Reference to a protease domain of a protease includes the single, two- and multi-chain forms of any of these proteins. A protease domain of a protein contains all of the requisite properties of that protein required for its proteolytic activity, such as for example, its catalytic center.

As used herein, a "catalytically active portion" or "catalytically active domain" of a protease, for example an MTSP-1 polypeptide, refers to the protease domain, or any fragment or portion thereof that retains protease activity. For example, a catalytically active portion of a MTSP-1 polypeptide can be a MTSP-1 protease domain including an isolated single chain form of the protease domain or an activated two-chain form. The zymogen form of each protein is single chain form, which can be converted to the active two chain form by cleavage. The protease domain also can be converted to a two chain form. Significantly, at least in vitro, the single chain forms of the proteases and catalytic domains or proteolytically active portions thereof (typically C-terminal truncations) exhibit protease activity.

As used herein, a "nucleic acid encoding a protease domain or catalytically active portion of a protease" refers to a nucleic acid encoding only the recited single chain protease domain or active portion thereof, and not the other contiguous portions of the protease as a continuous sequence.

As used herein, recitation that a polypeptide consists essentially of the protease domain means that the only portion of the polypeptide is a protease domain or a catalytically active portion thereof. The polypeptide can optionally, and generally will, include additional non-protease-derived sequences of amino acids.

As used herein, an "active site of a protease" refers to the substrate binding site where catalysis of the substrate occurs. The structure and chemical properties of the active site allow the recognition and binding of the substrate and subsequent hydrolysis and cleavage of the scissile bond in the substrate. The active site of a protease contains amino acids that contribute to the catalytic mechanism of peptide cleavage, as well as amino acids that contribute to substrate sequence recognition, such as amino acids that contribute to extended substrate binding specificity.

As used herein, target site in C3 refers to a site that, when cleaved, inactivates C3. Exemplary of such site is:

| | | | | (residues 737-744 of SEQ ID NO: 9) | | | |
|---|---|---|---|---|---|---|---|
| Q | H | A | R | ↓ | A | S | H L |
| P4 | P3 | P2 | P1 | ↓ | P1' | | P4'. |

As used herein, the "substrate recognition site" or "cleavage sequence" refers to the sequence recognized by the active site of a protease that is cleaved by a protease. Typically, a cleavage sequence for a serine protease is six residues in length to match the extended substrate specificity of many proteases, but can be longer or shorter depending upon the protease. Typically, for example, for a serine protease, a cleavage sequence is made up of the P1-P4 and P1'-P4' amino acids in a substrate, where cleavage occurs after the P1 position. Typically, a cleavage sequence for a serine protease is six residues in length to match the extended substrate specificity of many proteases, but can be longer or shorter depending upon the protease.

As used herein, "target substrate" refers to a substrate that is cleaved by a protease. Typically, the target substrate is specifically cleaved at its substrate recognition site by a protease. Minimally, a target substrate includes the amino acids that make up the cleavage sequence. Optionally, a target substrate includes a peptide containing the cleavage sequence and any other amino acids. A full-length protein, allelic variant, isoform, or any portion thereof, containing a cleavage sequence recognized by a protease, is a target substrate for that protease. For example, for purposes herein in which complement inactivation is intended, a target substrate is complement protein C3, or any portion or fragment thereof containing a cleavage sequence recognized by a MTSP-1 polypeptide. Such target substrates can be purified proteins, or can be present in a mixture, such as a mixture in vitro or a mixture in vivo. Mixtures can include, for example, blood or serum or breast milk, or other tissue fluids. Additionally, a target substrate includes a peptide or protein containing an additional moiety that does not affect cleavage of the substrate by a protease. For example, a target substrate can include a four amino acid peptide or a full-length protein chemically linked to a fluorogenic moiety. The proteases can be modified to exhibit greater substrate specificity for a target substrate.

As used herein, "MTSP-1" or "MTSP1" or "membrane-type serine protease" "MTSP-1 polypeptide" refers to any MTSP-1 polypeptide including, but not limited to, a recombinantly produced polypeptide, a synthetically produced polypeptide and a MTSP-1 polypeptide extracted or isolated from cells or tissues including, but not limited to, epithelial cells, cancer cells, liver and blood. Alternative names that are used interchangeably for MTSP-1 include membrane-type serine protease and matriptase and Epithin and TMPRSS1 and Suppressor of tumorigenicity 14 protein and Prostamin and Serine protease 14 (ST14) and Serine protease TADG-15 and Tumor-associated differentially-expressed gene 15 (TADG-15) protein. MTSP-1 includes related polypeptides from different species including, but not limited to animals of human and non-human origin. Human MTSP-1 includes MTSP-1, allelic variants, isoforms, synthetic molecules from nucleic acids, protein isolated from human tissue and cells, and modified forms thereof.

Exemplary unmodified human MTSP-1 polypeptides include, but are not limited to, unmodified and wild-type MTSP-1 polypeptides (SEQ ID NO:1) and the protease domain (such as the single-chain protease domain of MTSP-1 set forth in SEQ ID NO: 2). One of skill in the art would recognize that the referenced positions of the full length wild-type MTSP-1 polypeptide (SEQ ID NO:1) differ by 614 amino acid residues when compared to the MTSP-1 protease domain (SEQ ID NO:2). Thus, the first amino acid residue of SEQ ID NO:2 "corresponds to" the six hundred and fifteenth (615th) amino acid residue of SEQ ID NO:1. In another embodiment, an MTSP-1 polypeptide can be any one or more of the allelic variants of MTSP-1 as set forth in SEQ ID NO:99.

An MTSP-1 protease occurs as a single chain zymogen, and as an activated two-chain polypeptide. Reference to MTSP-1 includes active single-chain and two-chain forms thereof. The MTSP-1 polypeptides provided herein can be further modified, such as by chemical modification or post-translational modification. Such modifications include, but are not limited to, glycosylation, PEGylation, albumination, farnesylation, carboxylation, hydroxylation, phosphorylation, HESylation, PASylation, and other polypeptide modifications known in the art.

MTSP-1 includes MTSP-1 from any species, including human and non-human species. MTSP-1 polypeptides of non-human origin include, but are not limited to, murine and rat MTSP-1 polypeptides. Exemplary MTSP-1 polypeptides of non-human origin include, for example, mouse (*Mus musculus*, SEQ ID NO:12) and rat (*Rattus norvegicus*, SEQ ID NO:13).

Reference to MTSP-1 polypeptides also includes precursor polypeptides and mature MTSP-1 polypeptides in single-chain or two-chain forms, truncated forms thereof that have activity, the isolated protease domain and includes allelic variants and species variants, variants encoded by splice variants, and other variants, including polypeptides that have at least or at least about 40%, 45%, 50%, 55%, 65%, 70%, 75%, 80%, 85%, 90%, 95%, 96%, 97%, 98%, 99% or more sequence identity to full length form (SEQ ID NO:1 or 3) or the protease domain thereof (SEQ ID NO: 2 or 4). MTSP-1 polypeptides include, but are not limited to, tissue-specific isoforms and allelic variants thereof, synthetic molecules prepared by translation of nucleic acids, proteins generated by chemical synthesis, such as syntheses that include ligation of shorter polypeptides, through recombinant methods, proteins isolated from human and non-human tissue and cells, chimeric MTSP-1 polypeptides and modified forms thereof. MTSP-1 polypeptides also include fragments or portions of MTSP-1 that are of sufficient length or include appropriate regions to retain at least one activity (upon activation if needed) of a full-length mature polypeptide. In one example the portion of MTSP-1 is the protease domain, such as, for example, the protease domain set forth in SEQ ID NO: 2 which corresponds to amino acids 615-855 of the WT MTSP-1 sequence set forth in SEQ ID NO: 1. MTSP-1 polypeptides also include those that contain chemical or posttranslational modifications and those that do not contain chemical or posttranslational modifications. Such modifications include, but are not limited to, PEGylation, albumination, glycosylation, farnesylation, carboxylation, hydroxylation, phosphorylation, HESylation, PASylation, and other polypeptide modifications known in the art.

As used herein, "MTSP-1 protease" or "MTSP-1 protease domain" refers to any MTSP-1 polypeptide including, but not limited to, a recombinantly produced polypeptide, a synthetically produced polypeptide and a MTSP-1 polypeptide extracted or isolated from cells or tissues including, but not limited to, liver and blood. MTSP-1 protease includes related polypeptides from different species including, but not limited to animals of human and non-human origin. A human MTSP-1 protease or MTSP-1 protease domain includes MTSP-1, allelic variants, isoforms, synthetic molecules from nucleic acids, protein isolated from human tissue and cells, and modified forms thereof. Exemplary reference human MTSP-1 protease domains include, but are not limited to, unmodified and wild-type MTSP-1 protease domain (SEQ ID NO:2) and an alternate protease domain (such as the MTSP-1 protease domain set forth in SEQ ID NO: 4). One of skill in the art would recognize that the referenced positions of the MTSP-1 protease domain (SEQ ID NO:2) differ by 614 amino acid residues when compared to the full length MTSP-1 polypeptide (SEQ ID NO:1), which is the MTSP-1 polypeptide containing the full length WT sequence. Thus, the first amino acid residue of SEQ ID NO:2 "corresponds to" the six hundred and fifteenth (615th) amino acid residue of SEQ ID NO:1.

As used herein, a "modification" is in reference to modification of a sequence of amino acids of a polypeptide or a sequence of nucleotides in a nucleic acid molecule and includes deletions, insertions, and replacements of amino acids or nucleotides, respectively. Modified MT-SP1 polypeptides refer to MT-SP1 polypeptides containing alterations in the primary sequence of the polypeptide. Methods of modifying a polypeptide are routine to those of skill in the art, such as by using recombinant DNA methodologies. Reference to other modifications, such as post-translational modifications, and conjugation to moieties, such as polymers, such as PEG moieties, and tags for detection or isolation, are specified as such.

As used herein, "substitution" or "replacement" refers to the replacing of one or more nucleotides or amino acids in a native, target, wild-type or other nucleic acid or polypeptide sequence with an alternative nucleotide or amino acid, without changing the length (as described in numbers of residues) of the molecule. Thus, one or more substitutions in a molecule does not change the number of amino acid residues or nucleotides of the molecule. Amino acid replacements compared to a particular polypeptide can be expressed in terms of the number of the amino acid residue along the length of the polypeptide sequence. For example, a modified polypeptide having a modification in the amino acid at the $35^{th}$ position of the amino acid sequence that is a substitution/replacement of Arginine (Arg; R) with glutamine (Gln; Q) can be expressed as R35Q, Arg35Gln, or 35Q. Simply R35 can be used to indicate that the amino acid at the modified $35^{th}$ position is an arginine.

As used herein, a "modified MTSP-1" or "modified MTSP-1 polypeptide" refers to a MTSP-1 protease that exhibits altered activity, such as altered substrate specificity, compared to the unmodified form. Such proteases include 1, 2, 3, 4, 5, 6, 7, 8, 9, 10, 11, 12, 13, 14, 15, 16, 17, 18, 19, 20, or more modifications (i.e., changes in amino acids) compared to a wild type MTSP-1 such that an activity, such as substrate specificity or selectivity, of the MTSP-1 protease for cleaving complement protein C3 is altered. A modified MTSP-1 can be a full-length MTSP-1 protease, or can be a portion thereof of a full length protease, such as the protease domain of MTSP-1, as long as the modified MTSP-1 protease contains modifications in regions that alter the activity or substrate specificity of the protease and the protease is proteolytically active. A modified MTSP-1 protease, or a modified MTSP-1 protease domain, also can include other modifications in regions that do not impact on substrate specificity of the protease. Hence, a modified MTSP-1 polypeptide typically has 60%, 70%, 80%, 85%, 90%, 91%, 92%, 93%, 94%, 95%, 96%, 97%, 98%, 99% or more sequence identity to a corresponding sequence of amino acids of a wild type MTSP-1 polypeptide. A modified full-length MTSP-1 polypeptide or a catalytically active portion thereof or a protease domain thereof of a modified MTSP-1 polypeptide can include polypeptides that are fusion proteins as long as the fusion protein possesses the target specificity.

As used herein, chymotrypsin numbering refers to the amino acid numbering of a mature chymotrypsin polypeptide of SEQ ID NO: 1. Alignment of a protease domain of another protease, such as for example, the protease domain of MTSP-1, can be made with chymotrypsin. In such an instance, the amino acids of MTSP-1 that correspond to amino acids of chymotrypsin are given the numbering of the chymotrypsin amino acids. Corresponding positions can be determined by such alignment by one of skill in the art using manual alignments or by using the numerous alignment programs available (for example, BLASTP). Corresponding positions also can be based on structural alignments, for example by using computer simulated alignments of protein structure. Recitation that amino acids of a polypeptide correspond to amino acids in a disclosed sequence refers to amino acids identified upon alignment of the polypeptide with the disclosed sequence to maximize identity or homology (where conserved amino acids are aligned) using a standard alignment algorithm, such as the GAP algorithm. The corresponding chymotrypsin numbers of amino acid positions 615-855 of the MTSP-1 polypeptide set forth in SEQ ID NO:1 are provided in Table 1. The amino acid positions relative to the sequence set forth in SEQ ID NO:1 are in normal font, the amino acid residues at those positions are in bold, and the corresponding chymotrypsin numbers are in italics. For example, upon alignment of the serine protease domain of MTSP-1 (SEQ ID NO: 2) with mature chymotrypsin, V at position 1 in the MTSP-1 protease domain is given the chymotrypsin numbering of V16. Subsequent amino acids are numbered accordingly. In one example, an F at amino acid position 708 of full-length MTSP-1 (SEQ ID NO:1) or at position 94 of the protease domain of MTSP-1 (SEQ ID NO:2), corresponds to F99 based on chymotrypsin numbering. Where a residue exists in a protease, but is not present in chymotrypsin, the amino acid residue is given a letter notation. For example, residues in chymotrypsin that are part of a loop with amino acid 60 based on chymotrypsin numbering, but are inserted in the MTSP-1 sequence compared to chymotrypsin, are referred to for example as D60b or R60c. These residues correspond to D661 and R662, respectively, by numbering relative to the mature MTSP-1 sequence (human) set forth in SEQ ID NO:1.

TABLE 1

Chymotrypsin numbering of MTSP-1

| 615 | 616 | 617 | 618 | 619 | 620 | 621 | 622 | 623 |
|---|---|---|---|---|---|---|---|---|
| V | V | G | G | T | D | A | D | E |
| 16 | 17 | 18 | 19 | 20 | 21 | 22 | 23 | 24 |
| 624 | 625 | 626 | 627 | 628 | 629 | 630 | 631 | 632 |
| G | E | W | P | W | Q | V | S | L |
| 25 | 26 | 27 | 28 | 29 | 30 | 31 | 32 | 33 |
| 633 | 634 | 635 | 636 | 637 | 638 | 639 | 640 | 641 |
| H | A | L | G | Q | G | H | I | C |
| 34 | 35 | 36 | 37 | 38 | 39 | 40 | 41 | 42 |
| 642 | 643 | 644 | 645 | 646 | 647 | 648 | 649 | 650 |
| G | A | S | L | I | S | P | N | W |
| 43 | 44 | 45 | 46 | 47 | 48 | 49 | 50 | 51 |
| 651 | 652 | 653 | 654 | 655 | 656 | 657 | 658 | 659 |
| L | V | S | A | A | H | C | Y | I |
| 52 | 53 | 54 | 55 | 56 | 57 | 58 | 59 | 60 |
| 660 | 661 | 662 | 663 | 664 | 665 | 666 | 667 | 668 |
| D | D | R | G | F | R | Y | S | D |
| 60a | 60b | 60c | 60d | 60e | 60f | 60g | 60h | 60i |

TABLE 1-continued

Chymotrypsin numbering of MTSP-1

| 669 | 670 | 671 | 672 | 673 | 674 | 675 | 676 | 677 |
|---|---|---|---|---|---|---|---|---|
| P | T | Q | W | T | A | F | L | G |
| 61 | 62 | 63 | 64 | 65 | 66 | 67 | 68 | 69 |

| 678 | 679 | 680 | 681 | 682 | 683 | 684 | 685 | 686 |
|---|---|---|---|---|---|---|---|---|
| L | H | D | Q | S | Q | R | S | A |
| 70 | 71 | 72 | 73 | 74 | 74a | 75 | 76 | 77 |

| 687 | 688 | 689 | 690 | 691 | 692 | 693 | 694 | 695 |
|---|---|---|---|---|---|---|---|---|
| P | G | V | Q | E | R | R | L | K |
| 78 | 79 | 80 | 81 | 82 | 83 | 84 | 85 | 86 |

| 696 | 697 | 698 | 699 | 700 | 701 | 702 | 703 | 704 |
|---|---|---|---|---|---|---|---|---|
| R | I | I | S | H | P | F | F | N |
| 87 | 88 | 89 | 90 | 91 | 92 | 93 | 94 | 95 |

| 705 | 706 |  | 707 | 708 | 709 | 710 | 711 | 712 |
|---|---|---|---|---|---|---|---|---|
| D | F | | T | F | D | Y | D | I |
| 96 | 97 | 97a | 98 | 99 | 100 | 101 | 102 | 103 |

| 713 | 714 | 715 | 716 | 717 | 718 | 719 | 720 | 721 |
|---|---|---|---|---|---|---|---|---|
| A | L | L | E | L | E | K | P | A |
| 104 | 105 | 106 | 107 | 108 | 109 | 110 | 111 | 112 |

| 722 | 723 | 724 | 725 | 726 | 727 | 728 | 729 | 730 |
|---|---|---|---|---|---|---|---|---|
| E | Y | S | S | M | V | R | P | I |
| 113 | 114 | 115 | 116 | 117 | 118 | 119 | 120 | 121 |

| 731 | 732 | 733 | 734 | 735 | 736 | 737 | 738 | 739 |
|---|---|---|---|---|---|---|---|---|
| C | L | P | D |  | A | S | H | V | F |
| 122 | 123 | 124 | | 126 | 127 | 128 | 129 | 130 |

| 740 | 741 | 742 | 743 | 744 | 745 | 746 | 747 | 748 |
|---|---|---|---|---|---|---|---|---|
| P | A | G | K | A | I | W | V | T |
| 131 | 132 | 133 | 134 | 135 | 136 | 137 | 138 | 139 |

| 749 | 750 | 751 | 752 | 753 | 754 | 755 | 756 | 757 |
|---|---|---|---|---|---|---|---|---|
| G | W | G | H | T | Q | Y | G | G |
| 140 | 141 | 142 | 143 | 144 | 145 | 146 | 147 | 148 |

| | 758 | 759 | 760 | 761 | 762 | 763 | 764 | 765 |
|---|---|---|---|---|---|---|---|---|
| | T | G | A | L | I | L | Q | K |
| 149 | 150 | 151 | 152 | 153 | 154 | 155 | 156 | 157 |

| 766 | 767 | 768 | 769 | 770 | 771 | 772 | 773 | 774 |
|---|---|---|---|---|---|---|---|---|
| G | E | I | R | V | I | N | Q | T |
| 158 | 159 | 160 | 161 | 162 | 163 | 164 | 165 | 166 |

| 775 | 776 | 777 | 778 | 779 | 780 | 781 | 782 | 783 |
|---|---|---|---|---|---|---|---|---|
| T | C | E | N | L | L | P | Q | Q |
| 167 | 168 | 169 | 170 | 171 | 172 | 173 | 174 | 175 |

| 784 | 785 | 786 | 787 | 788 | 789 | 790 | 791 | 792 |
|---|---|---|---|---|---|---|---|---|
| I | T | P | R | M | M | C | V | G |
| 176 | 177 | 178 | 179 | 180 | 181 | 182 | 183 | 184 |

| 793 | 794 | 795 | 796 | 797 | 798 | 799 | 800 | 801 |
|---|---|---|---|---|---|---|---|---|
| F | L | S | G | G | V | D | S | C |
| 184a | 185 | 186 | 186a | 187 | 188 | 189 | 190 | 191 |

| 802 | 803 | 804 | 805 | 806 | 807 | 808 | 809 | 810 |
|---|---|---|---|---|---|---|---|---|
| Q | G | D | S | G | G | P | L | S |
| 192 | 193 | 194 | 195 | 196 | 197 | 198 | 199 | 200 |

| 811 | 812 | 813 | 814 | 815 | 816 | 817 | 818 | 819 |
|---|---|---|---|---|---|---|---|---|
| S | V | E | A | D | G | R | I | F |
| 201 | 202 | 203 | 204 | 204a | 205 | 206 | 207 | 208 |

| 820 | 821 | 822 | 823 | 824 | 825 | 826 | 827 | 828 |
|---|---|---|---|---|---|---|---|---|
| Q | A | G | V | V | S | W | G | D |
| 209 | 210 | 211 | 212 | 213 | 214 | 215 | 216 | 217 |

| 829 | 830 | 831 | 832 | 833 | 834 | 835 | 836 | 837 |
|---|---|---|---|---|---|---|---|---|
| G | C | A | Q | R | N | K | P | G |
| 216 | 219 | 220 | 221 | 222 | 223 | 224 | 225 | 226 |

| 838 | 839 | 840 | 841 | 842 | 843 | 844 | 845 | 846 |
|---|---|---|---|---|---|---|---|---|
| V | Y | T | R | L | P | L | F | R |
| 227 | 228 | 229 | 230 | 231 | 232 | 233 | 234 | 235 |

| 847 | 848 | 849 | 850 | 851 | 852 | 853 | 854 | 855 |
|---|---|---|---|---|---|---|---|---|
| D | W | I | K | E | N | T | G | V |
| 236 | 237 | 238 | 239 | 240 | 241 | 242 | 243 | 244 |

As used herein, $k_{cat}$ is a measure of the catalytic activity of an enzyme; the units of $k_{cat}$ are seconds$^{-1}$. The reciprocal of $k_{cat}$ is the time required by an enzyme molecule to "turn over" one substrate molecule; $k_{cat}$ measures the number of substrate molecules turned over per enzyme molecule per second. $k_{cat}$ also is called the turnover number.

As used herein, specificity for a target substrate refers to a preference for cleavage of a target substrate by a protease compared to a another substrate, referred to as a non-target substrate. Specificity is reflected in the specificity constant ($k_{cat}/K_m$), which is a measure of the affinity of a protease for its substrate and the efficiency of the enzyme. $k_{cat}/K_m$ is a measure of enzyme efficiency; a large value of $k_{cat}$ (rapid turnover) or a small value of $K_m$ (high affinity for substrate) makes $k_{cat}/K_m$ large.

As used herein, a specificity constant for cleavage is ($k_{cat}/K_m$), wherein $K_m$ is the Michaelis-Menton constant ([S] at one half $V_{max}$) and $k_{cat}$ is the $V_{max}/[E_T]$, where $E_T$ is the final enzyme concentration. The parameters $k_{cat}$, $K_m$ and $k_{cat}/K_m$ can be calculated by graphing the inverse of the substrate concentration versus the inverse of the velocity of substrate cleavage, and fitting to the Lineweaver-Burk equation ($1/\text{velocity}=(K_m/V_{max})(1/[S])+1/V_{max}$; where $V_{max}=[E_T]k_{cat}$). Any method to determine the rate of increase of cleavage over time in the presence of various concentrations of substrate can be used to calculate the specificity constant. For example, a substrate is linked to a fluorogenic moiety, which is released upon cleavage by a protease. By determining the rate of cleavage at different enzyme concentrations, $k_{cat}$ can be determined for a particular protease. The specificity constant can be used to determine the preference of a protease for one target substrate over another substrate.

As used herein, substrate specificity refers to the preference of a protease for one target substrate over another. Substrate specificity can be measured as a ratio of specificity constants.

As used herein, a substrate specificity ratio is the ratio of specificity constants and can be used to compare specificities of two or more proteases or a protease for two more substrates. For example, substrate specificity of a protease for competing substrates or of competing proteases for a substrate can be compared by comparing $k_{cat}/K_m$. For example, a protease that has a specificity constant of $2 \times 10^6$ $M^{-1}sec^{-1}$ for a target substrate and $2 \times 10^4$ $M^{-1}sec^{-1}$ for a non-target substrate is more specific for the target substrate. Using the specificity constants from above, the protease has a substrate specificity ratio of 100 for the target substrate.

As used herein, preference or substrate specificity for a target substrate can be expressed as a substrate specificity ratio. The particular value of the ratio that reflects a preference is a function of the substrates and proteases at issue. A substrate specificity ratio that is greater than 1 signifies a preference for a target substrate and a substrate specificity less than 1 signifies a preference for a non-target substrate. Generally, a ratio of at least or about 1 reflects a sufficient difference for a protease to be considered a candidate therapeutic.

As used herein, altered specificity refers to a change in substrate specificity of a modified protease compared to a starting wild type protease. Generally, the change in specificity is a reflection of the change in preference of a modified protease for a target substrate compared to a wild type substrate of the protease (herein referred to as a non-target substrate). Typically, modified MTSP-1 proteases provided herein exhibit increased substrate specificity for complement protein C3 compared to the substrate specificity of the wild type MTSP-1 protease. For example, a modified protease that has a substrate specificity ratio of 100 for a target substrate versus a non-target substrate exhibits a 10-fold increased specificity compared to a scaffold protease with a substrate specificity ratio of 10. In another example, a modified protease that has a substrate specificity ratio of 1 compared to a ratio of 0.1, exhibits a 10-fold increase in substrate specificity. To exhibit increased specificity compared to a scaffold protease, a modified protease has a 1.5-fold, 2-fold, 5-fold, 10-fold, 50-fold, 100-fold, 200-fold, 300-fold, 400-fold, 500-fold or more greater substrate specificity for any one of more of the complement proteins.

As used herein, "selectivity" can be used interchangeably with specificity when referring to the ability of a protease to choose and cleave one target substrate from among a mixture of competing substrates. Increased selectivity of a protease for a target substrate compared to any other one or more target substrates can be determined, for example, by comparing the specificity constants of cleavage of the target substrates by a protease. For example, if a protease has a specificity constant of cleavage of $2 \times 10^6$ $M^{-1}sec^{-1}$ for a target substrate and $2 \times 10^4$ $M^{-1}sec^{-1}$ for any other one of more substrates, the protease is more selective for the target substrate.

As used herein, an "activity" or a "functional activity" of a polypeptide, such as a protease, refers to any activity exhibited by the polypeptide. Such activities can be empirically determined. Exemplary activities include, but are not limited to, ability to interact with a biomolecule, for example, through substrate-binding, DNA binding, or dimerization, enzymatic activity, for example, kinase activity or proteolytic activity. For a protease (including protease fragments), activities include, but are not limited to, the ability to specifically bind a particular substrate, affinity and/or specificity of substrate-binding (e.g., high or low affinity and/or specificity), effector functions, such as the ability to promote substrate (e.g., protein, i.e. C3) inhibition, neutralization, cleavage or clearance, and in vivo activities, such as the ability to promote protein cleavage or clearance.

Activity can be assessed in vitro or in vivo using recognized assays, such as ELISA, flow cytometry, surface plasmon resonance or equivalent assays to measure on- or off-rate, immunohistochemistry and immunofluorescence histology and microscopy, cell-based assays, and binding assays. For example, for a protease, e.g., a modified MTSP-1 protease, activities can be assessed by measuring substrate protein cleavage, turnover, residual activity, stability and/or levels in vitro and/or in vivo. The results of such in vitro assays that indicate that a polypeptide exhibits an activity can be correlated to activity of the polypeptide in vivo, in which in vivo activity can be referred to as therapeutic activity, or biological activity. Activity of a modified polypeptide can be any level of percentage of activity of the unmodified polypeptide, including, but not limited to, at or about 1% of the activity, 2%, 3%, 4%, 5%, 10%, 20%, 30%, 40%, 50%, 60%, 70%, 80%, 90%, 91%, 92%, 93%, 94%, 95%, 96%, 97%, 98%, 99%, 100%, 200%, 300%, 400%, 500%, or more of activity compared to the unmodified polypeptide. Assays to determine functionality or activity of modified (or variant) proteases are well-known in the art.

Functional activities include, but are not limited to, biological activity, catalytic or enzymatic activity, antigenicity (ability to bind to or compete with a polypeptide for binding to an anti-polypeptide antibody), immunogenicity, ability to form multimers, and the ability to specifically bind to a receptor or ligand for the polypeptide.

As used herein, a functional activity with reference to a complement protein refers to a complement-mediated function including, but not limited to, anaphylaxis, opsonization, chemotaxis, or cell lysis. Nonlimiting assays for testing activities of complement include hemolysis of red blood cells, and detection of complement effector molecules such as by ELISA or SDS-PAGE.

As used herein, catalytic activity or cleavage activity refers to the activity of a protease as assessed in in vitro proteolytic assays that detect proteolysis of a selected substrate. Cleavage activity can be measured by assessing catalytic efficiency of a protease.

As used herein, activity towards a target substrate refers to cleavage activity and/or functional activity, or other measurement that reflects the activity of a protease on or towards a target substrate. A functional activity of a complement protein target substrate by a protease can be measured by assessing an $IC_{50}$ in a complement assay such as red blood cell lysis, or other such assays known by one of skill in the art or provided herein to assess complement activity. Cleavage activity can be measured by assessing catalytic efficiency of a protease. For purposes herein, an activity is increased if a protease exhibits greater proteolysis or cleavage of a target substrate and/or modulates (i.e., activates or inhibits) a functional activity of a complement protein as compared to in the absence of the protease.

As used herein, "increased activity" with reference to a modified MTSP-1 polypeptide means that, when tested under the same conditions, the modified MTSP-1 polypeptide exhibits greater activity compared to an unmodified MTSP-1 polypeptide not containing the amino acid replacement(s). For example, a modified MTSP-1 polypeptide exhibits at least or about at least 110%, 120%, 130%, 140%, 150%, 160%, 170%, 180%, 190%, 200%, 250%, 300%, 400%, 500%, 600%, 700%, 800%, 900%, 1000% or more of the activity of the unmodified or reference MTSP-1 polypeptide.

As used herein, the term "the same," when used in reference to antibody binding affinity, means that the $EC_{50}$, association constant (Ka) or dissociation constant (Kd) is within about 1 to 100 fold or 1 to 10 fold of that of the reference antibody (1-100 fold greater affinity or 1-100 fold less affinity, or any numerical value or range or value within such ranges, than the reference antibody).

As used herein, binding activity refers to characteristics of a molecule, e.g., a polypeptide, relating to whether or not, and how, it binds one or more binding partners. Binding activities include the ability to bind the binding partner(s), the affinity with which it binds to the binding partner (e.g., high affinity), the strength of the bond with the binding partner and/or specificity for binding with the binding partner.

As used herein, $EC_{50}$, also called the apparent Kd, is the concentration (e.g., nM) of protease, where 50% of the maximal activity is observed on a fixed amount of substrate (e.g., the concentration of modified MTSP-1 polypeptide required to cleave through 50% of the available hC3). Typically, $EC_{50}$ values are determined from sigmoidal dose-response curves, where the $EC_{50}$ is the concentration at the inflection point. A high protease affinity for its substrate correlates with a low $EC_{50}$ value and a low affinity corresponds to a high $EC_{50}$ value. Affinity constants can be determined by standard kinetic methodology for protease reactions, for example, immunoassays, such as ELISA, followed by curve-fitting analysis.

As used herein, "affinity constant" refers to an association constant (Ka) used to measure the affinity or molecular binding strength between a protease and a substrate. The higher the affinity constant the greater the affinity of the protease for the substrate. Affinity constants are expressed in units of reciprocal molarity (i.e., M−1) and can be calculated from the rate constant for the association-dissociation reaction as measured by standard kinetic methodology for protease-substrate reactions (e.g., immunoassays, surface plasmon resonance, or other kinetic interaction assays known in the art). The binding affinity of an protease also can be expressed as a dissociation constant, or Kd. The dissociation constant is the reciprocal of the association constant, Kd=1/Ka. Hence, an affinity constant also can be represented by the Kd. Affinity constants can be determined by standard kinetic methodology for protease reactions, for example, immunoassays, surface plasmon resonance (SPR) (Rich and Myszka (2000) *Curr. Opin. Biotechnol* 11:54; Englebienne (1998) *Analyst.* 123:1599), isothermal titration calorimetry (ITC) or other kinetic interaction assays known in the art (see, e.g., Paul, ed., Fundamental Immunology, 2nd ed., Raven Press, New York, pages 332-336 (1989)). Instrumentation and methods for real time detection and monitoring of binding rates are known and are commercially available (e.g., BIAcore 2000, BIAcore AB, Uppsala, Sweden and GE Healthcare Life Sciences; Malmqvist (2000) *Biochem. Soc. Trans.* 27:335).

Methods for calculating affinity are well-known, such as methods for determining $EC_{50}$ values or methods for determining association/dissociation constants. For example, in terms of $EC_{50}$, high binding affinity means that the protease specifically binds to a target protein with an $EC_{50}$ that is less than about 10 ng/mL, 9 ng/mL, 8 ng/mL, 7 ng/mL, 6 ng/mL, 5 ng/mL, 4 ng/mL, 3 ng/mL, 2 ng/mL, 1 ng/mL or less. High binding affinity also can be characterized by an equilibrium dissociation constant (Kd) of $10^{-6}$M or lower, such as $10^{-7}$ M, $10^{-8}$ M, $10^{-10}$ M, $10^{-11}$ M or $10^{-12}$M or lower. In terms of equilibrium association constant (Ka), high binding affinity is generally associated with Ka values of greater than or equal to about $10^6$ M$^{-1}$, greater than or equal to about $10^7$ M$^{-1}$, greater than or equal to about $10^8$ M$^{-1}$, or greater than or equal to about $10^9$ M$^{-1}$, $10^{10}$ M$^{-1}$, $10^{11}$ M$^{-1}$ or $10^{12}$ M$^{-1}$.

Affinity can be estimated empirically or affinities can be determined comparatively, e.g., by comparing the affinity of two or more antibodies for a particular antigen, for example, by calculating pairwise ratios of the affinities of the antibodies tested. For example, such affinities can be readily determined using conventional techniques, such as by ELISA; equilibrium dialysis; surface plasmon resonance; by radioimmunoassay using radiolabeled target antigen; or by another method known to the skilled artisan. The affinity data can be analyzed, for example, by the method of Scatchard et al., *Ann N.Y. Acad. Sci.*, 51:660 (1949) or by curve fitting analysis, for example, using a 4 Parameter Logistic nonlinear regression model using the equation: $y=((A-D)/(1+((x/C)^B)))+D$, where A is the minimum asymptote, B is the slope factor, C is the inflection point ($EC_{50}$), and D is the maximum asymptote.

As used herein, "$ED_{50}$" is the dose (e.g., mg/kg or nM) of a protease (e.g., a modified MTSP-1 protease) that produces a specified result (e.g., cleavage of the complement protein C3) in 50% of the total population (e.g., total amount of C3 present in the sample).

As used herein, "substantially the same" when used in reference to $EC_{50}$, association constant (Ka) or dissociation constant (Kd), or $ED_{50}$ effective dose means that the Ka, Kd, $EC_{50}$ or $ED_{50}$ is within about 5 to 5000 fold greater or less than the Ka, Kd, $EC_{50}$ or $ED_{50}$, of the reference MTSP-1 (5-5000 fold greater or 5-5000 fold less than the reference MTSP-1, i.e., wild-type MTSP-1).

As used herein, the term "surface plasmon resonance" refers to an optical phenomenon that allows for the analysis of real-time interactions by detection of alterations in protein concentrations within a biosensor matrix, for example, using the BIAcore system (GE Healthcare Life Sciences).

As used herein, a human protein is one encoded by a nucleic acid molecule, such as DNA, present in the genome of a human, including all allelic variants and conservative variations thereof. A variant or modification of a protein is a human protein if the modification is based on the wild type or prominent sequence of a human protein.

As used herein, the residues of naturally occurring α-amino acids are the residues of those 20 α-amino acids found in nature which are incorporated into protein by the specific recognition of the charged tRNA molecule with its cognate mRNA codon in humans.

As used herein, non-naturally occurring amino acids refer to amino acids that are not genetically encoded.

As used herein, "nucleic acid" refers to at least two linked nucleotides or nucleotide derivatives, including a deoxyribonucleic acid (DNA) and a ribonucleic acid (RNA) and analogs thereof, joined together, typically by phosphodiester linkages. Also included in the term "nucleic acid" are analogs of nucleic acids such as peptide nucleic acid (PNA), phosphorothioate DNA, and other such analogs and derivatives or combinations thereof. Nucleic acids also include DNA and RNA derivatives containing, for example, a nucleotide analog or a "backbone" bond other than a phosphodiester bond, for example, a phosphotriester bond, a phosphoramidate bond, a phosphorothioate bond, a thioester bond, or a peptide bond (peptide nucleic acid). The term also includes, as equivalents, derivatives, variants and analogs of either RNA or DNA made from nucleotide analogs, single (sense or antisense) and double-stranded nucleic acids. Deoxyribonucleotides include deoxyadenosine, deoxycytidine, deoxyguanosine and deoxythymidine. For RNA, the uracil base is uridine. Nucleic acids can be single or double-stranded. When referring to probes or primers, which are optionally labeled, such as with a detectable label, such as a fluorescent or radiolabel, single-stranded molecules are contemplated. Such molecules are typically of a length such that their target is statistically unique or of low copy number (typically less than 5, generally less than 3) for probing or priming a library. Generally a probe or primer contains at least 14, 16 or 30 contiguous nucleotides of sequence complementary to or identical to a gene of interest. Probes and primers can be 10, 20, 30, 50, 100 or more nucleotides long.

As used herein, an isolated nucleic acid molecule is one which is separated from other nucleic acid molecules which are present in the natural source of the nucleic acid molecule. An "isolated" nucleic acid molecule, such as a cDNA molecule, can be substantially free of other cellular material, or culture medium when produced by recombinant techniques, or substantially free of chemical precursors or other chemicals when chemically synthesized. Exemplary isolated nucleic acid molecules provided herein include isolated nucleic acid molecules encoding a MTSP-1 protease provided.

As used herein, "synthetic," with reference to, for example, a synthetic nucleic acid molecule or a synthetic gene or a synthetic peptide refers to a nucleic acid molecule or polypeptide molecule that is produced by recombinant methods and/or by chemical synthesis methods.

As used herein, "polypeptide" refers to two or more amino acids covalently joined. The terms "polypeptide" and "protein" are used interchangeably herein.

As used herein, a "peptide" refers to a polypeptide that is from 2 to about or 40 amino acids in length.

As used herein, the amino acids which occur in the various sequences of amino acids provided herein are identified according to their known, three-letter or one-letter abbreviations (Table 2). The nucleotides which occur in the various nucleic acid fragments are designated with the standard single-letter designations used routinely in the art.

As used herein, an "amino acid" is an organic compound containing an amino group and a carboxylic acid group. A polypeptide contains two or more amino acids. For purposes herein, amino acids include the twenty naturally-occurring amino acids (Table 2), non-natural amino acids and amino acid analogs (i.e., amino acids wherein the α-carbon has a side chain).

As used herein, the amino acids, which occur in the various amino acid sequences of polypeptides herein, are identified according to their well-known, three-letter or one-letter abbreviations (see Table 2). The nucleotides, which occur in the various nucleic acid molecules and fragments, are designated with the standard single-letter designations used routinely in the art.

As used herein, "amino acid residue" refers to an amino acid formed upon chemical digestion (hydrolysis) of a polypeptide at its peptide linkages. The amino acid residues described herein are presumed to be in the "L" isomeric form. Residues in the "D" isomeric form, which are so designated, can be substituted for any L-amino acid residue as long as the desired functional property is retained by the polypeptide. NH$_2$ refers to the free amino group present at the amino terminus of a polypeptide. COOH refers to the free carboxy group present at the carboxyl terminus of a polypeptide. In keeping with standard polypeptide nomenclature described in *J. Biol. Chem.*, 243: 3557-3559 (1968), and adopted in 37 C.F.R. §§ 1.821-1.822, abbreviations for amino acid residues are shown in Table 2:

TABLE 2

Table of Correspondence

| SYMBOL | | |
|---|---|---|
| 1-Letter | 3-Letter | AMINO ACID |
| Y | Tyr | Tyrosine |
| G | Gly | Glycine |
| F | Phe | Phenylalanine |
| M | Met | Methionine |
| A | Ala | Alanine |
| S | Ser | Serine |
| I | Ile | Isoleucine |
| L | Leu | Leucine |
| T | Thr | Threonine |
| V | Val | Valine |
| P | Pro | Proline |
| K | Lys | Lysine |
| H | His | Histidine |
| Q | Gln | Glutamine |
| E | Glu | Glutamic acid |
| Z | Glx | Glu and/or Gln |
| W | Trp | Tryptophan |
| R | Arg | Arginine |
| D | Asp | Aspartic acid |
| N | Asn | Asparagine |
| B | Asx | Asn and/or Asp |
| C | Cys | Cysteine |
| X | Xaa | Unknown or other |

All sequences of amino acid residues represented herein by a formula have a left to right orientation in the conventional direction of amino-terminus to carboxyl-terminus. In addition, the phrase "amino acid residue" is defined to include the amino acids listed in the Table of Correspondence (Table 2), modified, non-natural and unusual amino acids. Furthermore, a dash at the beginning or end of an amino acid residue sequence indicates a peptide bond to a further sequence of one or more amino acid residues or to an amino-terminal group such as NH$_2$ or to a carboxyl-terminal group such as COOH.

As used herein, "naturally occurring amino acids" refer to the 20 L-amino acids that occur in polypeptides. As used herein, the residues of naturally occurring α-amino acids are the residues of those 20 α-amino acids found in nature which are incorporated into protein by the specific recognition of the charged tRNA molecule with its cognate mRNA codon in humans.

As used herein, "non-natural amino acid" refers to an organic compound that has a structure similar to a natural amino acid but has been modified structurally to mimic the structure and reactivity of a natural amino acid. Non-naturally occurring amino acids, thus, include, for example, amino acids or analogs of amino acids other than the 20 naturally occurring amino acids and include, but are not limited to, the D-stereoisomers of amino acids. Exemplary non-natural amino acids are known to those of skill in the art, and include, but are not limited to, para-acetyl Phenylalanine, para-azido Phenylalanine, 2-Aminoadipic acid (Aad), 3-Aminoadipic acid (bAad), β-alanine/β-Amino-propionic acid (Bala), 2-Aminobutyric acid (Abu), 4-Aminobutyric acid/piperidinic acid (4Abu), 6-Aminocaproic acid (Acp), 2-Aminoheptanoic acid (Ahe), 2-Aminoisobutyric acid (Aib), 3-Aminoisobutyric acid (Baib), 2-Aminopimelic acid (Apm), 2,4-Diaminobutyric acid (Dbu), Desmosine (Des), 2,2'-Diaminopimelic acid (Dpm), 2,3-Diaminopropionic acid (Dpr), N-Ethylglycine (EtGly), N-Ethylasparagine (EtAsn), Hydroxylysine (Hyl), allo-Hydroxylysine (Ahyl), 3-Hydroxyproline (3Hyp), 4-Hydroxyproline (4Hyp), Isodesmosine (Ide), allo-Isoleucine (Aile), N-Methylglycine, sarcosine (MeGly), N-Methylisoleucine (MeIle), 6-N-Methyllysine (MeLys), N-Methylvaline (MeVal), Norvaline (Nva), Norleucine (Nle), and Ornithine (Orn). Exemplary non-natural amino acids are described herein and are known to those of skill in the art.

As used herein, an isokinetic mixture is one in which the molar ratios of amino acids has been adjusted based on their reported reaction rates (see, e.g., Ostresh et al. (1994) *Biopolymers* 34:1681).

As used herein, a DNA construct is a single or double stranded, linear or circular DNA molecule that contains segments of DNA combined and juxtaposed in a manner not found in nature. DNA constructs exist as a result of human manipulation, and include clones and other copies of manipulated molecules.

As used herein, a DNA segment is a portion of a larger DNA molecule having specified attributes. For example, a DNA segment encoding a specified polypeptide is a portion of a longer DNA molecule, such as a plasmid or plasmid fragment, which, when read from the 5' to 3' direction, encodes the sequence of amino acids of the specified polypeptide.

As used herein, the term ortholog means a polypeptide or protein obtained from one species that is the functional counterpart of a polypeptide or protein from a different species. Sequence differences among orthologs are the result of speciation.

As used herein, the term polynucleotide means a single- or double-stranded polymer of deoxyribonucleotides or ribonucleotide bases read from the 5' to the 3' end. Polynucleotides include RNA and DNA, and can be isolated from natural sources, synthesized in vitro, or prepared from a combination of natural and synthetic molecules. The length of a polynucleotide molecule is given herein in terms of nucleotides (abbreviated "nt") or base pairs (abbreviated "bp"). The term nucleotides is used for single- and double-stranded molecules where the context permits. When the term is applied to double-stranded molecules it is used to denote overall length and will be understood to be equivalent to the term base pairs. It will be recognized by those skilled in the art that the two strands of a double-stranded polynucleotide can differ slightly in length and that the ends thereof can be staggered; thus all nucleotides within a double-stranded polynucleotide molecule cannot be paired. Such unpaired ends will, in general, not exceed 20 nucleotides in length.

As used herein, alignment of a sequence refers to the use of homology to align two or more sequences of nucleotides or amino acids. Typically, two or more sequences that are related by 50% or more identity are aligned. An aligned set of sequences refers to 2 or more sequences that are aligned at corresponding positions and can include aligning sequences derived from RNAs, such as ESTs and other cDNAs, aligned with genomic DNA sequence. Related or variant polypeptides or nucleic acid molecules can be aligned by any method known to those of skill in the art. Such methods typically maximize matches, and include methods, such as using manual alignments and by using the numerous alignment programs available (e.g., BLASTP) and others known to those of skill in the art. By aligning the sequences of polypeptides or nucleic acids, one skilled in the art can identify analogous portions or positions, using conserved and identical amino acid residues as guides. Further, one skilled in the art also can employ conserved amino acid or nucleotide residues as guides to find corresponding amino acid or nucleotide residues between and among human and non-human sequences. Corresponding positions also can be based on structural alignments, for example by using computer simulated alignments of protein structure. In other instances, corresponding regions can be identified. One skilled in the art also can employ conserved amino acid residues as guides to find corresponding amino acid residues between and among human and non-human sequences.

As used herein, "sequence identity" refers to the number of identical or similar amino acids or nucleotide bases in a comparison between a test and a reference polypeptide or polynucleotide. Sequence identity can be determined by sequence alignment of nucleic acid or protein sequences to identify regions of similarity or identity. For purposes herein, sequence identity is generally determined by alignment to identify identical residues. The alignment can be local or global. Matches, mismatches and gaps can be identified between compared sequences. Gaps are null amino acids or nucleotides inserted between the residues of aligned sequences so that identical or similar characters are aligned. Generally, there can be internal and terminal gaps. Sequence identity can be determined by taking into account gaps as the number of identical residues/length of the shortest sequence×100. When using gap penalties, sequence identity can be determined with no penalty for end gaps (e.g., terminal gaps are not penalized). Alternatively, sequence identity can be determined without taking into account gaps as the number of identical positions/length of the total aligned sequence×100.

As used herein, "at a position corresponding to" or recitation that nucleotides or amino acid positions "correspond to" nucleotides or amino acid positions in a disclosed sequence, such as set forth in the Sequence listing, refers to nucleotides or amino acid positions identified upon alignment with the disclosed sequence to maximize identity using a standard alignment algorithm, such as the GAP algorithm. For purposes herein, alignment of a MTSP-1 sequence is to the amino acid sequence of the protease domain of human MTSP-1 set forth in SEQ ID NO: 2, or particularly a reference MTSP-1 of SEQ ID NO:4. By aligning the sequences, one skilled in the art can identify corresponding residues, for example, using conserved and identical amino acid residues as guides. In general, to identify corresponding positions, the sequences of amino acids are aligned so that the highest order match is obtained (see, e.g.: *Computational Molecular Biology*, Lesk, A. M., ed., Oxford University Press, New York, 1988; *Biocomputing: Informatics and Genome Projects*, Smith, D. W., ed., Academic Press, New York, 1993; *Computer Analysis of Sequence Data, Part I*, Griffin, A. M., and Griffin, H. G., eds., Humana Press, New Jersey, 1994; *Sequence Analysis in Molecular Biology*, von Heinje, G., Academic Press, 1987; and *Sequence Analysis Primer*, Gribskov, M. and Devereux, J., eds., M Stockton Press, New York, 1991; and Carillo et al. (1988) *SIAM J Applied Math* 48:1073). Alternatively, the skilled person can number the residues by chymotrypsin number, thereby identify corresponding residues. For closely related sequences, a computer algorithm is not needed; alignment can be done visually.

As used herein, a "global alignment" is an alignment that aligns two sequences from beginning to end, aligning each letter in each sequence only once. An alignment is produced, regardless of whether or not there is similarity or identity between the sequences. For example, 50% sequence identity based on "global alignment" means that in an alignment of the full sequence of two compared sequences each of 100 nucleotides in length, 50% of the residues are the same. It is understood that global alignment also can be used in determining sequence identity even when the length of the aligned sequences is not the same. The differences in the terminal ends of the sequences will be taken into account in determining sequence identity, unless the "no penalty for end gaps" is selected. Generally, a global alignment is used on sequences that share significant similarity over most of their length. Exemplary algorithms for performing global alignment include the Needleman-Wunsch algorithm (Needleman et al. (1970) *J Mol. Biol.* 48: 443). Exemplary programs for performing global alignment are publicly available and include the Global Sequence Alignment Tool available at the National Center for Biotechnology Information (NCBI) website (ncbi.nlm.nih.gov/), and the program available at deepc2.psi.iastate.edu/aat/align/align.html.

As used herein, a "local alignment" is an alignment that aligns two sequence, but only aligns those portions of the sequences that share similarity or identity. Hence, a local alignment determines if sub-segments of one sequence are present in another sequence. If there is no similarity, no alignment will be returned. Local alignment algorithms include BLAST or Smith-Waterman algorithm (*Adv. Appl. Math.* 2: 482 (1981)). For example, 50% sequence identity based on "local alignment" means that in an alignment of the full sequence of two compared sequences of any length, a region of similarity or identity of 100 nucleotides in length has 50% of the residues that are the same in the region of similarity or identity.

For purposes herein, sequence identity can be determined by standard alignment algorithm programs used with default gap penalties established by each supplier. Default parameters for the GAP program can include: (1) a unary comparison matrix (containing a value of 1 for identities and 0 for non-identities) and the weighted comparison matrix of Gribskov et al. (1986) *Nucl. Acids Res.* 14: 6745, as described by Schwartz and Dayhoff, eds., *Atlas of Protein Sequence and Structure*, National Biomedical Research Foundation, pp. 353-358 (1979); (2) a penalty of 3.0 for each gap and an additional 0.10 penalty for each symbol in each gap; and (3) no penalty for end gaps. Whether any two nucleic acid molecules have nucleotide sequences or any two polypeptides have amino acid sequences that are at least 80%, 85%, 90%, 95%, 96%, 97%, 98% or 99% "identical," or other similar variations reciting a percent identity, can be determined using known computer algorithms based on local or global alignment (see e.g., wikipedia.org/wiki/Sequence_alignment_software, providing links to dozens of known and publicly available alignment databases and programs). Generally, for purposes herein sequence identity is determined using computer algorithms based on global alignment, such as the Needleman-Wunsch Global Sequence Alignment tool available from NCBI/BLAST (blast.ncbi.nlm.nih.gov/Blast.cgi?CMD=Web&Page_TYPE=BlastHome); LAlign (William Pearson implementing the Huang and Miller algorithm (*Adv. Appl. Math.* (1991) 12:337-357)); and the program from Xiaoqui Huang available at deepc2.psi.iastate.edu/aat/align/align.html. Generally, when comparing nucleotide sequences herein, an alignment with penalty for end gaps is used. Local alignment also can be used when the sequences being compared are substantially the same length.

Therefore, as used herein, the term "identity" represents a comparison or alignment between a test and a reference polypeptide or polynucleotide. In one non-limiting example, "at least 90% identical to" refers to percent identities from 90% to 100% relative to the reference polypeptide or polynucleotide. Identity at a level of 90% or more is indicative of the fact that, assuming for exemplification purposes a test and reference polypeptide or polynucleotide length of 100 amino acids or nucleotides are compared, no more than 10% (i.e., 10 out of 100) of amino acids or nucleotides in the test polypeptide or polynucleotide differs from that of the reference polypeptides. Similar comparisons can be made between a test and reference polynucleotides. Such differences can be represented as point mutations randomly distributed over the entire length of an amino acid sequence or they can be clustered in one or more locations of varying length up to the maximum allowable, e.g., 10/100 amino acid difference (approximately 90% identity). Differences also can be due to deletions or truncations of amino acid residues. Differences are defined as nucleic acid or amino acid substitutions, insertions or deletions. Depending on the length of the compared sequences, at the level of homologies or identities above about 85-90%, the result can be independent of the program and gap parameters set; such high levels of identity can be assessed readily, often without relying on software.

As used herein, a disulfide bond (also called an S—S bond or a disulfide bridge) is a single covalent bond derived from the coupling of thiol groups. Disulfide bonds in proteins are formed between the thiol groups of cysteine residues, and stabilize interactions between polypeptide domains.

As used herein, "coupled" or "conjugated" means attached via a covalent or noncovalent interaction.

As used herein, "primer" refers to a nucleic acid molecule that can act as a point of initiation of template-directed DNA synthesis under appropriate conditions (e.g., in the presence of four different nucleoside triphosphates and a polymerization agent, such as DNA polymerase, RNA polymerase or reverse transcriptase) in an appropriate buffer and at a suitable temperature. It will be appreciated that certain nucleic acid molecules can serve as a "probe" and as a "primer." A primer, however, has a 3' hydroxyl group for extension. A primer can be used in a variety of methods, including, for example, polymerase chain reaction (PCR), reverse-transcriptase (RT)-PCR, RNA PCR, LCR, multiplex PCR, panhandle PCR, capture PCR, expression PCR, 3' and 5' RACE, in situ PCR, ligation-mediated PCR and other amplification protocols.

As used herein, "primer" refers to an oligonucleotide containing two or more deoxyribonucleotides or ribonucleotides, typically more than three, from which synthesis of a primer extension product can be initiated. Experimental conditions conducive to synthesis include the presence of nucleoside triphosphates and an agent for polymerization and extension, such as DNA polymerase, and a suitable buffer, temperature and pH.

As used herein, "primer pair" refers to a set of primers that includes a 5' (upstream) primer that hybridizes with the 5' end of a sequence to be amplified (e.g. by PCR) and a 3' (downstream) primer that hybridizes with the complement of the 3' end of the sequence to be amplified.

As used herein, "specifically hybridizes" refers to annealing, by complementary base-pairing, of a nucleic acid molecule (e.g. an oligonucleotide) to a target nucleic acid molecule. Those of skill in the art are familiar with in vitro and in vivo parameters that affect specific hybridization, such as length and composition of the particular molecule. Parameters particularly relevant to in vitro hybridization further include annealing and washing temperature, buffer composition and salt concentration. Exemplary washing conditions for removing non-specifically bound nucleic acid molecules at high stringency are 0.1×SSPE, 0.1% SDS, 65° C., and at medium stringency are 0.2×SSPE, 0.1% SDS, 50° C. Equivalent stringency conditions are known in the art.

The skilled person can readily adjust these parameters to achieve specific hybridization of a nucleic acid molecule to a target nucleic acid molecule appropriate for a particular application.

As used herein, substantially identical to a product means sufficiently similar so that the property of interest is sufficiently unchanged so that the substantially identical product can be used in place of the product.

As used herein, it also is understood that the terms "substantially identical" or "similar" varies with the context as understood by those skilled in the relevant art.

As used herein, the wild-type form of a polypeptide or nucleic acid molecule is a form encoded by a gene or by a coding sequence encoded by the gene. Typically, a wild-type form of a gene, or molecule encoded thereby, does not contain mutations or other modifications that alter function or structure. The term wild-type also encompasses forms with allelic variation as occurs among and between species.

As used herein, a predominant form of a polypeptide or nucleic acid molecule refers to a form of the molecule that is the major form produced from a gene. A "predominant form" varies from source to source. For example, different cells or tissue types can produce different forms of polypeptides, for example, by alternative splicing and/or by alternative protein processing. In each cell or tissue type, a different polypeptide can be a "predominant form."

As used herein, an allelic variant or allelic variation references any of two or more alternative forms of a gene occupying the same chromosomal locus. Allelic variation arises naturally through mutation, and can result in phenotypic polymorphism within populations. Gene mutations can be silent (no change in the encoded polypeptide) or can encode polypeptides having altered amino acid sequence. The term "allelic variant" also is used herein to denote a protein encoded by an allelic variant of a gene. Typically the reference form of the gene encodes a wild type form and/or predominant form of a polypeptide from a population or single reference member of a species. Typically, allelic variants, which include variants between and among species, have at least 80%, 90% or greater amino acid identity with a wild type and/or predominant form from the same species; the degree of identity depends upon the gene and whether comparison is interspecies or intraspecies. Generally, intraspecies allelic variants have at least or at least about 80%, 85%, 90% or 95% identity or greater with a wild type and/or predominant form, including at least or at least about 96%, 97%, 98%, 99% or greater identity with a wild type and/or predominant form of a polypeptide.

As used herein, "allele," which is used interchangeably herein with "allelic variant" refers to alternative forms of a gene or portions thereof. Alleles occupy the same locus or position on homologous chromosomes. When a subject has two identical alleles of a gene, the subject is said to be homozygous for that gene or allele. When a subject has two different alleles of a gene, the subject is said to be heterozygous for the gene. Alleles of a specific gene can differ from each other in a single nucleotide or several nucleotides, and can include substitutions, deletions and insertions of nucleotides. An allele of a gene also can be a form of a gene containing a mutation.

As used herein, species variants refer to variants in polypeptides among different species, including different mammalian species, such as mouse and human. Generally, species variants have about or at least 70%, 75%, 80%, 85%, 90%, 91%, 92%, 93%, 94%, 95%, 96%, 97%, 98% or 99% or more sequence identity. Corresponding residues between and among species variants can be determined by comparing and aligning sequences to maximize the number of matching nucleotides or residues, for example, such that identity between the sequences is equal to or greater than 95%, equal to or greater than 96%, equal to or greater than 97%, equal to or greater than 98% or equal to greater than 99%. The position of interest is then given the number assigned in the reference nucleic acid molecule. Alignment can be effected manually or by eye, particularly, where sequence identity is greater than 80%.

As used herein, a splice variant refers to a variant produced by differential processing of a primary transcript of genomic DNA that results in more than one type of mRNA.

As used herein, modification is in reference to modification of a sequence of amino acids of a polypeptide or a sequence of nucleotides in a nucleic acid molecule and includes deletions, insertions, and replacements of amino acids and nucleotides, respectively.

For purposes herein, amino acid substitutions, deletions and/or insertions, can be made in any of MTSP-1 polypeptide or catalytically active fragment thereof provided that the resulting protein exhibits protease activity or other activity (or, if desired, such changes can be made to eliminate activity). Modifications can be made by making conservative amino acid substitutions and also non-conservative amino acid substitutions. For example, amino acid substitutions that desirably or advantageously alter properties of the proteins can be made. In one embodiment, mutations that prevent degradation of the polypeptide can be made. Many proteases cleave after basic residues, such as R and K; to eliminate such cleavage, the basic residue is replaced with a non-basic residue. Interaction of the protease with an inhibitor can be blocked while retaining catalytic activity by effecting a non-conservative change at the site of interaction of the inhibitor with the protease. Other activities also can be altered. For example, receptor binding can be altered without altering catalytic activity.

Amino acid substitutions contemplated include conservative substitutions, such as those set forth in Table 3, which do not eliminate proteolytic activity. As described herein, substitutions that alter properties of the proteins, such as removal of cleavage sites and other such sites also are contemplated; such substitutions are generally non-conservative, but can be readily effected by those of skill in the art.

As used herein, suitable conservative substitutions of amino acids are known to those of skill in this art and can be made generally without altering the biological activity of the resulting molecule. Those of skill in this art recognize that, in general, single amino acid substitutions in non-essential regions of a polypeptide do not substantially alter biological activity (see, e.g., Watson et al. Molecular Biology of the Gene, 4th Edition, 1987, The Benjamin/Cummings Pub. Co., p. 224). Such substitutions can be made in accordance with those set forth in Table 3 as follows:

TABLE 3

| Original Residue | Exemplary conservative substitution |
| --- | --- |
| Ala (A) | Gly; Ser |
| Arg (R) | Lys |
| Asn (N) | Gln; His |
| Cys (C) | Ser |
| Gln (Q) | Asn |
| Glu (E) | Asp |
| Gly (G) | Ala; Pro |
| His (H) | Asn; Gln |
| Ile (I) | Leu; Val |
| Leu (L) | Ile; Val |

TABLE 3-continued

| Original Residue | Exemplary conservative substitution |
|---|---|
| Lys (K) | Arg; Gln; Glu |
| Met (M) | Leu; Tyr; Ile |
| Phe (F) | Met; Leu; Tyr |
| Ser (S) | Thr |
| Thr (T) | Ser |
| Trp (W) | Tyr |
| Tyr (Y) | Trp; Phe |
| Val (V) | Ile; Leu |

Other substitutions also are permissible and can be determined empirically or in accord with known conservative substitutions.

As used herein, the term promoter means a portion of a gene containing DNA sequences that provide for the binding of RNA polymerase and initiation of transcription. Promoter sequences are commonly, but not always, found in the 5' non-coding region of genes.

As used herein, isolated or purified polypeptide or protein or biologically-active portion thereof is substantially free of cellular material or other contaminating proteins from the cell of tissue from which the protein is derived, or substantially free from chemical precursors or other chemicals when chemically synthesized. Preparations can be determined to be substantially free if they appear free of readily detectable impurities as determined by standard methods of analysis, such as thin layer chromatography (TLC), gel electrophoresis and high performance liquid chromatography (HPLC), used by those of skill in the art to assess such purity, or sufficiently pure such that further purification would not detectably alter the physical and chemical properties, such as enzymatic and biological activities, of the substance. Methods for purification of the compounds to produce substantially chemically pure compounds are known to those of skill in the art. A substantially chemically pure compound, however, can be a mixture of stereoisomers. In such instances, further purification might increase the specific activity of the compound.

The term substantially free of cellular material includes preparations of proteins in which the protein is separated from cellular components of the cells from which it is isolated or recombinantly-produced. In one embodiment, the term substantially free of cellular material includes preparations of protease proteins having less that about 30% (by dry weight) of non-protease proteins (also referred to herein as a contaminating protein), generally less than about 20% of non-protease proteins or 10% of non-protease proteins or less that about 5% of non-protease proteins. When the protease protein or active portion thereof is recombinantly produced, it also is substantially free of culture medium, i.e., culture medium represents less than, about, or equal to 20%, 10% or 5% of the volume of the protease protein preparation.

As used herein, the term substantially free of chemical precursors or other chemicals includes preparations of protease proteins in which the protein is separated from chemical precursors or other chemicals that are involved in the synthesis of the protein. The term includes preparations of protease proteins having less than about 30% (by dry weight), 20%, 10%, 5% or less of chemical precursors or non-protease chemicals or components.

As used herein, production by recombinant means by using recombinant DNA methods refers to the use of the well-known methods of molecular biology for expressing proteins encoded by cloned DNA.

As used herein, "expression" refers to the process by which polypeptides are produced by transcription and translation of polynucleotides. The level of expression of a polypeptide can be assessed using any method known in art, including, for example, methods of determining the amount of the polypeptide produced from the host cell. Such methods can include, but are not limited to, quantitation of the polypeptide in the cell lysate by ELISA, Coomassie Blue staining following gel electrophoresis, Lowry protein assay and Bradford protein assay.

As used herein, a "host cell" is a cell that is used to receive, maintain, reproduce and/or amplify a vector. Host cells also can be used to express the polypeptide encoded by the vector. The nucleic acid contained in the vector is replicated when the host cell divides, thereby amplifying the nucleic acids.

As used herein, a "vector" or "plasmid" is a replicable nucleic acid from which one or more heterologous proteins can be expressed when the vector is transformed into an appropriate host cell. Reference to a vector includes discrete elements that are used to introduce heterologous nucleic acid into cells for either expression or replication thereof. Reference to a vector also includes those vectors into which a nucleic acid encoding a polypeptide or fragment thereof can be introduced, typically by restriction digest and ligation. Reference to a vector also includes those vectors that contain nucleic acid encoding a protease, such as a modified MTSP-1. The vector is used to introduce the nucleic acid encoding the polypeptide into the host cell for amplification of the nucleic acid or for expression/display of the polypeptide encoded by the nucleic acid. The vectors typically remain episomal, but can be designed to effect integration of a gene or portion thereof into a chromosome of the genome. Also contemplated are vectors that are artificial chromosomes, such as yeast artificial chromosomes and mammalian artificial chromosomes. Selection and use of such vehicles are well-known to those of skill in the art. A vector also includes "virus vectors" and "viral vectors."

As used herein, an "expression vector" includes vectors capable of expressing DNA that is operatively linked with regulatory sequences, such as promoter regions, that are capable of effecting expression of such DNA fragments. Such additional segments can include promoter and terminator sequences, and optionally can include one or more origins of replication, one or more selectable markers, an enhancer, a polyadenylation signal, and the like. Expression vectors are generally derived from plasmid or viral DNA, or can contain elements of both. Thus, an expression vector refers to a recombinant DNA or RNA construct, such as a plasmid, a phage, recombinant virus or other vector that, upon introduction into an appropriate host cell, results in expression of the cloned DNA. Appropriate expression vectors are well known to those of skill in the art and include those that are replicable in eukaryotic cells and/or prokaryotic cells and those that remain episomal or those which integrate into the host cell genome.

As used herein, vector also includes "virus vectors" or "viral vectors." Viral vectors are engineered viruses, eukaryotic and prokaryotic, that can contain heterologous nucleic acid, to effect transfer and expression of thereof in host cells. Viral vectors are characterized as eukaryotic and prokaryotic based upon the host infected by the virus from which the vector is derived, and the type of RNA polymerase (eukaryotic or prokaryotic) that recognizes the viral promoters. Hence, for example, a vector derived from adenovirus is a eukaryotic vector.

As used herein, an adenovirus refers to any of a group of DNA-containing viruses that cause conjunctivitis and upper respiratory tract infections in humans. As used herein, naked DNA refers to histone-free DNA that can be used for vaccines and gene therapy. Naked DNA is the genetic material that is passed from cell to cell during a gene transfer processed called transformation. In transformation, purified or naked DNA is taken up by the recipient cell which will give the recipient cell a new characteristic or phenotype.

As used herein, "operably linked" with reference to nucleic acid sequences, regions, elements or domains means that the nucleic acid regions are functionally related to each other. For example, nucleic acid encoding a leader peptide can be operably linked to nucleic acid encoding a polypeptide, whereby the nucleic acids can be transcribed and translated to express a functional fusion protein, wherein the leader peptide effects secretion of the fusion polypeptide. In some instances, the nucleic acid encoding a first polypeptide (e.g., a leader peptide) is operably linked to nucleic acid encoding a second polypeptide and the nucleic acids are transcribed as a single mRNA transcript, but translation of the mRNA transcript can result in one of two polypeptides being expressed. For example, an amber stop codon can be located between the nucleic acid encoding the first polypeptide and the nucleic acid encoding the second polypeptide, such that, when introduced into a partial amber suppressor cell, the resulting single mRNA transcript can be translated to produce either a fusion protein containing the first and second polypeptides, or can be translated to produce only the first polypeptide. In another example, a promoter can be operably linked to nucleic acid encoding a polypeptide, whereby the promoter regulates or mediates the transcription of the nucleic acid.

As used herein, "primary sequence" refers to the sequence of amino acid residues in a polypeptide or the sequence of nucleotides in a nucleic acid molecule.

As used herein, protein binding sequence refers to a protein or peptide sequence that is capable of specific binding to other protein or peptide sequences generally, to a set of protein or peptide sequences or to a particular protein or peptide sequence.

As used herein, a "tag" or an "epitope tag" refers to a sequence of amino acids, typically added to the N- or C-terminus of a polypeptide, such as a MTSP-1 provided herein. The inclusion of tags fused to a polypeptide can facilitate polypeptide purification and/or detection. Typically, a tag or tag polypeptide refers to a polypeptide that has enough residues to provide an epitope recognized by an antibody or can serve for detection or purification, yet is short enough such that it does not interfere with activity of the polypeptide to which it is linked. The tag polypeptide typically is sufficiently unique so that an antibody that specifically binds thereto does not substantially cross-react with epitopes in the polypeptide to which it is linked. Epitope tagged proteins can be affinity purified using highly specific antibodies raised against the tags.

Suitable tag polypeptides generally have at least 5 or 6 amino acid residues and usually between about 8-50 amino acid residues, typically between 9-30 residues. The tags can be linked to one or more proteins and permit detection of the protein or its recovery from a sample or mixture. Such tags are well-known and can be readily synthesized and designed. Exemplary tag polypeptides include those used for affinity purification and include, Small Ubiquitin-like Modifier (SUMO) tags, FLAG tags, His tags, the influenza hemagglutinin (HA) tag polypeptide and its antibody 12CA5, (Field et al. (1988) *Mol. Cell. Biol.* 8:2159-2165); the c-myc tag and the 8F9, 3C7, 6E10, G4, B7 and 9E10 antibodies thereto (see, e.g., Evan et al. (1985) *Molecular and Cellular Biology* 5:3610-3616); and the Herpes Simplex virus glycoprotein D (gD) tag and its antibody (Paborsky et al. (1990) *Protein Engineering* 3:547-553). An antibody used to detect an epitope-tagged antibody is typically referred to herein as a secondary antibody.

As used herein, metal binding sequence refers to a protein or peptide sequence that is capable of specific binding to metal ions generally, to a set of metal ions or to a particular metal ion.

As used herein the term assessing is intended to include quantitative and qualitative determination in the sense of obtaining an absolute value for the activity of a protease, or a domain thereof, present in the sample, and also of obtaining an index, ratio, percentage, visual or other value indicative of the level of the activity. Assessment can be direct or indirect and the chemical species actually detected need not of course be the proteolysis product itself but can for example be a derivative thereof or some further substance. For example, detection of a cleavage product of a complement protein, such as by SDS-PAGE and protein staining with Coomassie blue.

As used herein, biological activity refers to the in vivo activities of a compound or physiological responses that result upon in vivo administration of a compound, composition or other mixture. Biological activity, thus, encompasses therapeutic effects and pharmaceutical activity of such compounds, compositions and mixtures. Biological activities can be observed in in vitro systems designed to test or use such activities. Thus, for purposes herein a biological activity of a protease is its catalytic activity in which a polypeptide is hydrolyzed.

As used herein, equivalent, when referring to two sequences of nucleic acids, means that the two sequences in question encode the same sequence of amino acids or equivalent proteins. When equivalent is used in referring to two proteins or peptides, it means that the two proteins or peptides have substantially the same amino acid sequence with only amino acid substitutions (such as, but not limited to, conservative changes such as those set forth in Table 3, above) that do not substantially alter the activity or function of the protein or peptide. When equivalent refers to a property, the property does not need to be present to the same extent (e.g., two peptides can exhibit different rates of the same type of enzymatic activity), but the activities are usually substantially the same. Complementary, when referring to two nucleotide sequences, means that the two sequences of nucleotides are capable of hybridizing, typically with less than 25%, 15% or 5% mismatches between opposed nucleotides. If necessary, the percentage of complementarity will be specified. Typically the two molecules are selected such that they will hybridize under conditions of high stringency.

As used herein, an agent that modulates the activity of a protein or expression of a gene or nucleic acid either decreases or increases or otherwise alters the activity of the protein or, in some manner, up- or down-regulates or otherwise alters expression of the nucleic acid in a cell.

As used herein, a "chimeric protein" or "fusion protein" protease refers to a polypeptide operatively-linked to a different polypeptide. A chimeric or fusion protein provided herein can include one or more proteases or a portion thereof, such as single chain protease domains thereof, and one or more other polypeptides for any one or more of a transcriptional/translational control signals, signal sequences, a tag for localization, a tag for purification, part of a domain of an immunoglobulin G, and/or a targeting agent. These chimeric or fusion proteins include those produced by recombinant means as fusion proteins, those produced by chemical means, such as by chemical coupling, through, for example, coupling to sulfhydryl groups, and those produced by any other method whereby at least one protease, or a portion thereof, is linked, directly or indirectly via linker(s) to another polypeptide.

As used herein, operatively-linked when referring to a fusion protein refers to a protease polypeptide and a non-protease polypeptide that are fused in-frame to one another. The non-protease polypeptide can be fused to the N-terminus or C-terminus of the protease polypeptide.

As used herein, a targeting agent is any moiety, such as a protein or effective portion thereof, that provides specific binding of the conjugate to a cell surface receptor, which in some instances can internalize bound conjugates or portions thereof. A targeting agent also can be one that promotes or facilitates, for example, affinity isolation or purification of the conjugate; attachment of the conjugate to a surface; or detection of the conjugate or complexes containing the conjugate.

As used herein, "linker" refers to short sequences of amino acids that join two polypeptides (or nucleic acid encoding such polypeptides). "Peptide linker" refers to the short sequence of amino acids joining the two polypeptide sequences. Exemplary of polypeptide linkers are linkers joining two antibody chains in a synthetic antibody fragment such as an scFv fragment. Linkers are well-known and any known linkers can be used in the provided methods. Exemplary of polypeptide linkers are (Gly-Ser)n amino acid sequences, with some Glu or Lys residues dispersed throughout to increase solubility. Other exemplary linkers are described herein; any of these and other known linkers can be used with the provided compositions and methods.

As used herein, derivative or analog of a molecule refers to a portion derived from or a modified version of the molecule.

As used herein, "disease or disorder" refers to a pathological condition in an organism resulting from cause or condition including, but not limited to, infections, acquired conditions, genetic conditions, conditions related to environmental exposures and human behaviors, and conditions characterized by identifiable symptoms. Diseases or disorders include clinically diagnosed disease as well as disruptions in the normal state of the organism that have not been diagnosed as clinical disease. Diseases and disorders of interest herein are those involving complement activation, including those mediated by complement activation and those in which complement activation plays a role in the etiology or pathology. Diseases and disorders of interest herein include those characterized by complement activation (e.g., age-related macular degeneration and renal delayed graft function).

As used herein, macular degeneration occurs when the small central portion of the retina, known as the macula, deteriorates. There are two types of AMD: dry (atrophic) and wet (neovascular or exudative). Most AMD starts as the dry type and in 10-20% of individuals, it progresses to the wet type. Age-related macular degeneration is always bilateral (i.e., occurs in both eyes), but does not necessarily progress at the same pace in both eyes.

As used herein, age-related macular degeneration (AMD) is an inflammatory disease that causes visual impairment and blindness in older people. The proteins of the complement system are central to the development of this disease. Local and systemic inflammation in AMD are mediated by the deregulated action of the alternative pathway of the complement system.

As used herein, delayed graft function (DGF) is a manifestation of acute kidney injury (AKI) with attributes unique to the transplant process. It occurs post-transplant surgery. Delayed graft function (DGF) is a common complication frequently defined as the need for dialysis during the first post-transplant week. Intrinsic renal synthesis of the third complement component C3 (C3) contributes to acute rejection by priming a T-cell-mediated response. For example, in brain dead donors, local renal C3 levels are higher at procurement and inversely related to renal function 14 days after transplant.

As used herein, a complement-mediated disease or disorder is any disorder in which any one or more of the complement proteins plays a role in the disease, either due to an absence or presence of a complement protein or complement-related protein or activation or inactivation of a complement or complement-related protein. In some embodiments, a complement-mediated disorder is one that is due to a deficiency in a complement protein(s). In other embodiments as described herein a complement-mediated disorder is one that is due to activation or over-activation of a complement protein(s). A complement-mediated disorder also is one that is due to the presence of any one or more of the complement proteins and/or the continued activation of the complement pathway. As used herein, "macular degeneration-related disorder" refers to any of a number of conditions in which the retinal macula degenerates or becomes dysfunctional (e.g., as a consequence of decreased growth of cells of the macula, increased death or rearrangement of the cells of the macula (e.g., RPE cells), loss of normal biological function, or a combination of these events). Macular degeneration results in the loss of integrity of the histoarchitecture of the cells and/or extracellular matrix of the normal macula and/or the loss of function of the cells of the macula. Examples of macular degeneration-related disorder include age-related macular degeneration (AMD), geographic atrophy (GA), North Carolina macular dystrophy, Sorsby's fundus dystrophy, Stargardt's disease, pattern dystrophy, Best disease, dominant drusen, and malattia leventinese (radial drusen). Macular degeneration-related disorder also encompasses extramacular changes that occur prior to, or following dysfunction and/or degeneration of the macula. Thus, the term "macular degeneration-related disorder" also broadly includes any condition which alters or damages the integrity or function of the macula (e.g., damage to the RPE or Bruch's membrane). For example, the term encompasses retinal detachment, chorioretinal degenerations, retinal degenerations, photoreceptor degenerations, RPE degenerations, mucopolysaccharidoses, rod-cone dystrophies, cone-rod dystrophies and cone degenerations.

A macular degeneration-related disorder described herein includes AMD, such as, for example, a macular degeneration-related disorder treated by anti-VEGF treatment, such as, for example, anti-VEGF antibodies, or laser treatment, or an implantable telescope.

As used herein, "treating" a subject with a disease or condition means that the subject's symptoms are partially or totally alleviated, or remain static following treatment. Hence treatment encompasses prophylaxis, therapy and/or cure. Prophylaxis refers to prevention of a potential disease and/or a prevention of worsening of symptoms or progression of a disease. Treatment also encompasses any pharmaceutical use of a modified MTSP-1 polypeptide and compositions provided herein.

As used herein, "prevention" or prophylaxis refers to methods in which the risk or probability of developing a disease or condition is reduced.

As used herein, a "therapeutic agent," therapeutic regimen, radioprotectant, or chemotherapeutic mean conventional drugs and drug therapies, including vaccines, which are known to those skilled in the art. Radiotherapeutic agents are well known in the art.

As used herein, "treatment" means any manner in which the symptoms of a condition, disorder or disease are ameliorated or otherwise beneficially altered. Treatment also encompasses any pharmaceutical use of the compositions herein.

As used herein, "amelioration of the symptoms" of a particular disease or disorder by a treatment, such as by administration of a pharmaceutical composition or other therapeutic, refers to any lessening, whether permanent or temporary, lasting or transient, of the symptoms that can be attributed to or associated with administration of the composition or therapeutic.

As used herein, a "pharmaceutically effective agent" includes any therapeutic agent or bioactive agents, including, but not limited to, for example, anesthetics, vasoconstrictors, dispersing agents, and conventional therapeutic drugs, including small molecule drugs and therapeutic proteins.

As used herein an "effective amount" of a compound or composition for treating a particular disease is an amount that is sufficient to ameliorate, or in some manner reduce the symptoms associated with the disease. Such amount can be administered as a single dosage or can be administered according to a regimen, whereby it is effective. The amount can cure the disease but, typically, is administered in order to ameliorate the symptoms of the disease. Typically, repeated administration is required to achieve a desired amelioration of symptoms.

As used herein, a "therapeutically effective amount" or a "therapeutically effective dose" refers to the quantity of an agent, compound, material, or composition containing a compound that is at least sufficient to produce a therapeutic effect following administration to a subject. Hence, it is the quantity necessary for preventing, curing, ameliorating, arresting or partially arresting a symptom of a disease or disorder.

As used herein, a "therapeutic effect" means an effect resulting from treatment of a subject that alters, typically improves or ameliorates, the symptoms of a disease or condition or that cures a disease or condition.

As used herein, a "prophylactically effective amount" or a "prophylactically effective dose" refers to the quantity of an agent, compound, material, or composition containing a compound that when administered to a subject, have the intended prophylactic effect, e.g., preventing or delaying the onset, or reoccurrence, of disease or symptoms, reducing the likelihood of the onset, or reoccurrence, of disease or symptoms, or reducing the incidence of viral infection. The full prophylactic effect does not necessarily occur by administration of one dose, and can occur only after administration of a series of doses. Thus, a prophylactically effective amount can be administered in one or more administrations.

As used herein, "administration of a non-complement protease," such as a modified MTSP-1 protease, refers to any method in which the non-complement protease is contacted with its substrate. Administration can be effected in vivo or ex vivo or in vitro. For example, for ex vivo administration a body fluid, such as blood, is removed from a subject and contacted outside the body with the modified non-complement protease, such as a modified MTSP-1 protease. For in vivo administration, the modified non-complement protease, such as a modified MTSP-1 protease, can be introduced into the body, such as by local, topical, systemic and/or other route of introduction. In vitro administration encompasses methods, such as cell culture methods.

As used herein, "unit dose form" refers to physically discrete units suitable for human and animal subjects and packaged individually as is known in the art.

As used herein, "patient" or "subject" to be treated includes humans and human or non-human animals. Mammals include; primates, such as humans, chimpanzees, gorillas and monkeys; domesticated animals, such as dogs, horses, cats, pigs, goats and cows; and rodents such as mice, rats, hamsters and gerbils.

As used herein, a "combination" refers to any association between or among two or more items. The association can be spatial or refer to the use of the two or more items for a common purpose. The combination can be two or more separate items, such as two compositions or two collections, a mixture thereof, such as a single mixture of the two or more items, or any variation thereof. The elements of a combination are generally functionally associated or related.

As used herein, a "composition" refers to any mixture of two or more products or compounds (e.g., agents, modulators, regulators, etc.). It can be a solution, a suspension, liquid, powder, a paste, aqueous or non-aqueous formulations or any combination thereof.

As used herein, a stabilizing agent refers to compound added to the formulation to protect either the antibody or conjugate, such as under the conditions (e.g., temperature) at which the formulations herein are stored or used. Thus, included are agents that prevent proteins from degradation from other components in the compositions. Exemplary of such agents are amino acids, amino acid derivatives, amines, sugars, polyols, salts and buffers, surfactants, inhibitors or substrates and other agents as described herein.

As used herein, "fluid" refers to any composition that can flow. Fluids thus encompass compositions that are in the form of semi-solids, pastes, solutions, aqueous mixtures, gels, lotions, creams and other such compositions.

As used herein, an "article of manufacture" is a product that is made and sold. As used throughout this application, the term is intended to encompass a therapeutic agent with a modified MTSP-1 polypeptide or nucleic acid molecule contained in the same or separate articles of packaging.

As used herein, a "kit" refers to a packaged combination, optionally including reagents and other products and/or components for practicing methods using the elements of the combination. For example, kits containing a modified protease polypeptide, such as a modified MTSP-1 protease provided herein, or nucleic acid molecule provided herein and another item for a purpose including, but not limited to, administration, diagnosis, and assessment of a biological activity or property are provided. Kits optionally include instructions for use.

As used herein, a "cellular extract" refers to a preparation or fraction which is made from a lysed or disrupted cell.

As used herein, "animal" includes any animal, such as, but not limited to; primates including humans, gorillas and monkeys; rodents, such as mice and rats; fowl, such as chickens; ruminants, such as goats, cows, deer and sheep. Non-human animals exclude humans as the contemplated animal. The proteases provided herein are from any source, animal, plant, prokaryotic and fungal. Most proteases are of animal origin, including mammalian origin.

As used herein, a "single dosage" formulation refers to a formulation containing a single dose of therapeutic agent for direct administration. Single dosage formulations generally do not contain any preservatives.

As used herein, a multi-dose formulation refers to a formulation that contains multiple doses of a therapeutic agent and that can be directly administered to provide several single doses of the therapeutic agent. The doses can be administered over the course of minutes, hours, weeks, days or months. Multi-dose formulations can allow dose adjustment, dose-pooling and/or dose-splitting. Because multi-dose formulations are used over time, they generally contain one or more preservatives to prevent microbial growth.

As used herein, a "control" or "standard" refers to a sample that is substantially identical to the test sample, except that it is not treated with a test parameter, or, if it is a plasma sample, it can be from a normal volunteer not affected with the condition of interest. A control also can be an internal control. For example, a control can be a sample, such as a virus, that has a known property or activity.

As used herein, the singular forms "a," "an" and "the" include plural referents unless the context clearly dictates otherwise. Thus, for example, reference to "an" agent includes one or more agents.

As used herein, the term "or" is used to mean "and/or" unless explicitly indicated to refer to alternatives only or if the alternatives are mutually exclusive.

As used herein, ranges and amounts can be expressed as "about" a particular value or range. About also includes the exact amount. Hence "about 5 bases" means "about 5 bases" and also "5 bases."

As used herein, "optional" or "optionally" means that the subsequently described event or circumstance does or does not occur, and that the description includes instances where said event or circumstance occurs and instances where it does not. For example, an optionally substituted group means that the group is unsubstituted or is substituted.

As used herein, the abbreviations for any protective groups, amino acids and other compounds, are, unless indicated otherwise, in accord with their common usage, recognized abbreviations, or the IUPAC-IUB Commission on Biochemical Nomenclature (see, (1972) *Biochem.* 11:1726).

For clarity of disclosure, and not by way of limitation, the detailed description is divided into the subsections that follow.

B. MTSP-1 STRUCTURE AND FUNCTION

MTSP-1 (also called matriptase, TADG-15, suppressor of tumorigenicity 14, ST14; see SEQ ID NOS: 1, 2 and GenBank Accession NOs: AF118224 and AAD42765; U.S. Pat. No. 5,792,616; see, also Takeuchi (1999) *Proc. Natl. Acad. Sci. U.S.A.* 96:11054-1161) is a serine protease that cleaves proteins containing the amino acid sequence P4(Arg/Lys)-P3(X)-P2(Ser)-P1(Arg)-P1'(Ala) and P4(X)-P3(Arg/Lys)-P2(Ser)-P1(Arg)-P1'(Ala) where X corresponds to non-basic amino acids (Takeuchi (2000) *J Biol Chem* 275(34):26333-42) and can cleave various synthetic substrates with Arginine or Lysine residues at their P1 sites. MTSP-1 has at least three known physiological substrates, including urokinase-type plasminogen activator (u-PA), hepatocyte growth factor (HGF)/scatter factor and protease activated receptor-2 (PAR-2) (Takeuchi (2000) *J Biol Chem* 275(34):26333-42; Lee et al. (2000) *J Biol Chem* 275: 36720-36725). MTSP-1 is found in epithelial cells, and in many cancer tissues. MTSP-1 is involved in normal embryonic development. MTSP-1 co-localizes with E-adherin, a tight junction molecule that is necessary for normal embryonic development in mice.

Provided herein are modified membrane-type serine protease 1 (MTSP-1) polypeptides that are modified so that they cleave inhibitory sequences in C3, such that activation of C3 into C3a and C3b fragments is inhibited. The activity/specificity of the modified MTSP-1 polypeptides provided herein is such that they cleave C3 with greater activity and/or specificity or $k_{cat}/K_m$ compared to the unmodified MTSP-1 polypeptide, particularly of any of SEQ ID NOs: 1-4. The modified MTSP-1 polypeptides also can have reduced activity or specificity or both for a physiological substrate of the unmodified MTSP-1 polypeptide, such as, for example, proteinase-activated receptor-2 (PAR-2), urokinase-type plasminogen activator (uPA), and/or hepatocyte growth factor (HGF). Thus, the modified MTSP-1 polypeptides provided herein inhibit complement activation in a complement pathway. The Modified MTSP-1 Polypeptides also exhibit increased selectivity for cleaving C3 compared to other MTSP-1 substrates, such as, for example, proteinase-activated receptor-2 (PAR-2), urokinase-type plasminogen activator (uPA), and/or hepatocyte growth factor (HGF). Therefore, the Modified MTSP-1 Polypeptides provided herein do not exhibit undesired cleavage activities against physiological native MTSP-1 substrates so that they do not exhibit undesirable side effects.

1. Serine Proteases

Serine proteases (SPs), which include secreted enzymes and enzymes sequestered in cytoplasmic storage organelles, have a variety of physiological roles, including in blood coagulation, wound healing, digestion, immune responses and tumor invasion and metastasis. For example, chymotrypsin, trypsin, and elastase function in the digestive tract; Factor 10, Factor 11, Thrombin, and Plasmin are involved in clotting and wound healing; and C1r, C1s, and the C3 convertases play a role in complement activation.

A class of cell surface proteins designated type II transmembrane serine proteases are proteases which are membrane-anchored proteins with extracellular domains. As cell surface proteins, they play a role in intracellular signal transduction and in mediating cell surface proteolytic events. Other serine proteases are membrane bound and function in a similar manner. Others are secreted. Many serine proteases exert their activity upon binding to cell surface receptors, and, hence act at cell surfaces. Cell surface proteolysis is a mechanism for the generation of biologically active proteins that mediate a variety of cellular functions.

Serine proteases, including secreted and transmembrane serine proteases, are involved in processes that include neoplastic development and progression. While the precise role of these proteases has not been fully elaborated, serine proteases and inhibitors thereof are involved in the control of many intra- and extracellular physiological processes, including degradative actions in cancer cell invasion and metastatic spread, and neovascularization of tumors that are involved in tumor progression. Proteases are involved in the degradation and remodeling of extracellular matrix (ECM) and contribute to tissue remodeling, and are necessary for cancer invasion and metastasis. The activity and/or expression of some proteases have been shown to correlate with tumor progression and development.

More than 20 families (denoted S1-S27) of serine protease have been identified, and they are grouped into 6 clans (SA, SB, SC, SE, SF and SG) on the basis of structural similarity and other functional evidence (Rawlings N D et al. (1994) *Meth. Enzymol.* 244: 19-61). There are similarities in the reaction mechanisms of several serine peptidases. Chymotrypsin, subtilisin and carboxypeptidase C clans have a catalytic triad of serine, aspartate and histidine in common: serine acts as a nucleophile, aspartate as an electrophile, and histidine as a base. The geometric orientations of the catalytic residues are similar between families, despite different protein folds. The linear arrangements of the catalytic residues commonly reflect clan relationships. For example the catalytic triad in the chymotrypsin clan (SA) is ordered HDS, but is ordered DHS in the subtilisin clan (SB) and SDH in the carboxypeptidase clan (SC).

Examples of serine proteases of the chymotrypsin superfamily include tissue-type plasminogen activator (tPA), trypsin, trypsin-like protease, chymotrypsin, plasmin, elastase, urokinase (or urinary-type plasminogen activator, u-PA), acrosin, activated protein C, C1 esterase, cathepsin G, chymase, and proteases of the blood coagulation cascade including kallikrein, thrombin, and Factors VIIa, IXa, Xa, XIa, and XIIa (Barret, A. J., In: Proteinase Inhibitors, Ed. Barrett, A. J., Et al., Elsevier, Amsterdam, Pages 3-22 (1986); Strassburger, W. et al., (1983) *FEBS Lett.,* 157:219-223; Dayhoff, M. O., Atlas of Protein Sequence and Structure, Vol 5, National Biomedical Research Foundation, Silver Spring, Md. (1972); and Rosenberg, R. D. et al. (1986) *Hosp. Prac.,* 21: 131-137).

The activity of proteases in the serine protease family is dependent on a set of amino acid residues that form their active site. One of the residues is always a serine; hence their designation as serine proteases. For example, chymotrypsin, trypsin, and elastase share a similar structure and their active serine residue is at the same position (Ser-195) in all three. Despite their similarities, they have different substrate specificities; they cleave different peptide bonds during protein digestion. For example, chymotrypsin prefers an aromatic side chain on the residue whose carbonyl carbon is part of the peptide bond to be cleaved. Trypsin prefers a positively charged Lys or Arg residue at this position. Serine proteases differ markedly in their substrate recognition properties: some are highly specific (i.e., the proteases involved in blood coagulation and the immune complement system); some are only partially specific (i.e., the mammalian digestive proteases trypsin and chymotrypsin); and others, like subtilisin, a bacterial protease, are completely non-specific. Despite these differences in specificity, the catalytic mechanism of serine proteases is well conserved.

The mechanism of cleavage of a target protein by a serine protease is based on nucleophilic attack of the targeted peptidic bond by a serine. Cysteine, threonine or water molecules associated with aspartate or metals also can play this role. In many cases the nucleophilic property of the group is improved by the presence of a histidine, held in a "proton acceptor state" by an aspartate. Aligned side chains of serine, histidine and aspartate build the catalytic triad common to most serine proteases. For example, the active site residues of chymotrypsin, and serine proteases that are members of the same family as chymotrypsin, such as for example MTSP-1, are Asp102, His57, and Ser195.

The catalytic domains of all serine proteases of the chymotrypsin superfamily have sequence homology and structural homology. The sequence homology includes the conservation of: 1) the characteristic active site residues (e.g., Ser195, His57, and Asp102 in the case of trypsin); 2) the oxyanion hole (e.g., Gly193, Asp194 in the case of trypsin); and 3) cysteine residues that form disulfide bridges in the structure (Hartley, B. S., (1974) *Symp. Soc. Gen. Microbiol.,* 24: 152-182). The structural homology includes 1) a common fold characterized by two Greek key structures (Richardson, J. (1981) *Adv. Prot. Chem.,* 34:167-339); 2) a common disposition of catalytic residues; and 3) detailed preservation of the structure within the core of the molecule (Stroud, R. M. (1974) *Sci. Am.,* 231: 24-88).

Throughout the chymotrypsin family of serine proteases, the backbone interaction between the substrate and enzyme is completely conserved, but the side chain interactions vary considerably. The identity of the amino acids that contain the S1-S4 pockets of the active site determines the substrate specificity of that particular pocket. Grafting the amino acids of one serine protease to another of the same fold modifies the specificity of one to the other. Typically, the amino acids of the protease that contain the S1-S4 pockets are those that have side chains within 4 to 5 angstroms of the substrate. The interactions these amino acids have with the protease substrate are generally called "first shell" interactions because they directly contact the substrate. There, however, can be "second shell" and "third shell" interactions that ultimately position the first shell amino acids. First shell and second shell substrate binding effects are determined primarily by loops between beta-barrel domains. Because these loops are not core elements of the protein, the integrity of the fold is maintained while loop variants with novel substrate specificities can be selected during the course of evolution to fulfill necessary metabolic or regulatory niches at the molecular level. Typically for serine proteases, the following amino acids in the primary sequence are determinants of specificity: 195, 102, 57 (the catalytic triad); 189, 190, 191, 192, and 226 (S1); 57, the loop between 58 and 64, and 99 (S2); 192, 217, 218 (S3); the loop between Cys168 and Cys180, 215, and 97 to 100 (S4); and 41 and 151 (S2'), based on chymotrypsin numbering, where an amino acid in an S1 position affects P1 specificity, an amino acid in an S2 position affects P2 specificity, an amino acid in the S3 position affects P3 specificity, and an amino acid in the S4 position affects P4 specificity. Position 189 in a serine protease is a residue buried at the bottom of the pocket that determines the Si specificity. Structural determinants for MTSP-1 are listed in Table 4, with protease domains for each of the designated proteases aligned with that of the protease domain of chymotrypsin. The number underneath the Cys168-Cys182 and 60's loop column headings indicate the number of amino acids in the loop between the two amino acids and in the loop. The yes/no designation under the Cys191-Cys220 column headings indicates whether the disulfide bridge is present in the protease. These regions are variable within the family of chymotrypsin-like serine proteases and represent structural determinants in themselves.

2. Structure

MTSP-1 cDNA has been cloned from various mammalian species. Exemplary MTSP-1 precursor polypeptides include, but are not limited to, human (SEQ ID NO:1 and encoded by SEQ ID NO:5), mouse (SEQ ID NO:12), and rat (SEQ ID NO:13) MTSP-1 polypeptides. The human MTSP-1 mRNA transcript is normally translated to form a 855 amino acid wild-type protein (SEQ ID NO:1). The nucleic acid molecule whose sequence is set forth in SEQ ID NO:5 (see, also Genbank AF118224) encodes the 855 amino acid MTSP-1 (SEQ ID NO: 1, GenBank AAD42765). MTSP-1 is multidomain proteinase with a C-terminal serine proteinase domain (Friedrich et al. (2002) *J Biol Chem* 277(3):2160). A 683 amino acid variant of the protease has been isolated, but this protein appears to be a truncated form or an ectodomain form. As described in further detail below, MTSP-1 is a zymogen or proenzyme that is further processed by proteolytic cleavage at a canonical activation motif to generate a two chain mature MTSP-1 polypeptide.

At least five isoforms, produced by alternative splicing, of human MTSP-1 exist. Forms of MTSP-1 with a molecular mass of approximately 95, 78, 74, 45 and 25 kDA, corresponding to the full-length protein (95 kDa), residues 149-855 of SEQ ID NO: 1 (78 kDa), residues 190-855 of SEQ ID NO: 1 (73 kDa) or 205-855 of SEQ ID NO: 1 (74 kDa), residues 190-614 of SEQ ID NO: 1 (45.7 kDa), and residues 615-855 of SEQ ID NO: 1 (26 kDa), respectively, have been detected (Ge et al., (2006) *J Biol Chem* 281:7406-7412). Allelic variants and other variants of human MTSP-1 are known. For example, a naturally occurring variant G827R is associated with ichthyosis with hypotrichosis syndrome, characterized by skin hyperkeratosis (Basel-Vanagaite et al., (2007) *Am J Hum Genet* 80:467-477). In another example, a modified MTSP-1 polypeptide containing the amino acid modification C299S (C122S by chymotrypsin numbering) in the sequence of amino acids set forth in SEQ ID NO:1 (corresponding to the sequence of amino acids set forth in SEQ ID NO: 2) is known; the replacement of the free cysteine reduces aggregation of the encoded protein. Additional variants include those containing amino acid modifications M285I, R381S, H656A, D711A, and 5805A in full-length MTSP-1 set forth in SEQ ID NO:1.

MTSP-1 is highly expressed or active in prostate, breast, and colorectal cancers, and it is said to play a role in the metastasis of breast and prostate cancer. MTSP-1 also is expressed in a variety of epithelial tissues with high levels of activity and/or expression in the human gastrointestinal tract and the prostate. Other species of MTSP-1 are known. For example, a mouse homolog of MTSP-1 has been identified and is called epithin. MTSP-1 contains a transmembrane domain, two CUB domains, four LDLR repeats, and a serine protease domain (or peptidase Si domain) between amino acids 615-854 (set forth as SEQ ID NOS:2 and 7), which is highly conserved among all members of the peptidase Si family of serine proteases, such as for example with chymotrypsin (SEQ ID NOS:14 and 15). MTSP-1 is synthesized as an 855 amino acid zymogen, and activated to an active double chain enzyme form by cleavage between Arg614 and Val615. In addition, the single chain proteolytic domain alone is catalytically active and functional.

MTSP-1 belongs to the peptidase S1 family of serine proteases (also referred to as the chymotrypsin family), which also includes chymotrypsin and trypsin. Generally, chymotrypsin family members share sequence and structural homology with chymotrypsin. MTSP-1 is numbered herein according to the numbering of mature chymotrypsin, with its protease domain aligned with that of the protease domain of chymotrypsin and its residues numbered accordingly. Based on chymotrypsin numbering, active site residues are Asp102, His57, and Ser195. The linear amino acid sequence can be aligned with that of chymotrypsin and numbered according to the β sheets of chymotrypsin. Insertions and deletions occur in the loops between the beta sheets, but throughout the structural family, the core sheets are conserved. The serine proteases interact with a substrate in a conserved beta sheet manner. Up to 6 conserved hydrogen bonds can occur between the substrate and enzyme. All serine proteases of the chymotrypsin family have a conserved region at their N-terminus of the protease domain that is necessary for catalytic activity (i.e., IIGG, VVGG, or IVGG, where the first amino acid in this quartet is numbered according to the chymotrypsin numbering and given the designation Ile16. This numbering does not reflect the length of the precursor sequence).

The substrate specificity of MTSP-1 in the protease domain has been mapped using a positional scanning synthetic combinatorial library and substrate phage display (Takeuchi et al. (2000) *J Biol Chem* 275: 26333). Cleavage residues in substrates recognized by MTSP-1 contain Arg/Lys at P4 and basic residues or Gln at P3, small residues at P2, Arg or Lys at P1, and Ala at P1'. Effective substrates contain Lys-Arg-Ser-Arg in the P4 to P1 sites, respectively. Generally, the substrate specificity for MTSP-1 reveals a trend whereby if P3 is basic, then P4 tends to be non-basic; and if P4 is basic, then P3 tends to be non-basic. Known substrates for MTSP-1, including, for example, proteinase-activated receptor-2 (PAR-2), urokinase-type plasminogen activator (uPA), and hepatocyte growth factor (HGF), conform to the cleavage sequence for MTSP-1 specific substrates.

MTSP-1 can cleave selected synthetic substrates as efficiently as trypsin, but exhibit a more restricted specificity for substrates than trypsin. The catalytic domain of MTSP-1 has the overall structural fold of a (chymo)trypsin-like serine protease, but displays unique properties such as a hydrophobic/acidic S2/S4 subsites and an exposed 60 loop. Similarly, MTSP-1 does not indiscriminately cleave peptide substrates at accessible Lys or Arg residues, but requires recognition of additional residues surrounding the scissile peptide bond. This requirement for an extended primary sequence highlights the specificity of MTSP-1 for its substrates. For example, although MTSP-1 cleaves proteinase activated receptor-2 (PAR-2) (displaying a P4 to P1 target sequence of Ser-Lys-Gly-Arg), the enzyme does not activate proteins closely related to this substrate such as PAR-1, PAR-3, and PAR-4 that do not display target sequences matching the extended MTSP-1 specificity near the scissile bond (see Friedrich et al. (2002) *J Biol Chem* 277: 2160).

The protease domain of MTSP-1 (see, e.g., SEQ ID NOS: 2, 4) is composed of a pro-region and a catalytic domain. The catalytically active portion of the polypeptide begins after the autoactivation site at amino acid residue 611 of the mature protein (see, e.g., SEQ ID NOS: 1, 3 at RQAR followed by the residues VVGG). The S1 pocket of MTSP-1 and trypsin are similar with good complementarity for Lys as well as Arg P1 residues, thereby accounting for some similarities in substrate cleavage with trypsin. The accommodation of the P1-Lys residues is mediated by Ser190 whose side chain provides an additional hydrogen bond acceptor to stabilize the buried α-ammonium group (see Friedrich et al. (2002) *J Biol Chem* 277: 2160). The S2 pocket is shaped to accommodate small to medium-sized hydrophobic side chains of P2 amino acids and generally accepts a broad range of amino acids at the P2 position. Upon substrate binding, the S2 sub-site is not rigid as evidenced by the rotation of the Phe99 benzyl group. Association of the substrate amino acids at positions P3 (for either Gln or basic residues) and P4 (for Arg or Lys residues) appears to be mediated by electrostatic interactions in the S3 and S4 pockets with the acidic side chains of Asp-217 and/or Asp-96, which can favorably pre-orient specific basic peptide substrates as they approach the enzyme active site cleft. The side chain of a P3 residue also is able to hydrogen bond the carboxamide group of Gln192 or alternatively, the P3 side chain can extend into the S4 sub-site to form a hydrogen bond with Phe97 thereby weakening the inter-main chain hydrogen bonds with Gly216. In either conformation, a basic P3 side chain is able to interact favorably with the negative potential of the MTSP-1 S4 pocket. The mutual charge compensation and exclusion from the same S4 site explains the low probability of the simultaneous occurrence of Arg/Lys residues at P3 and P4 in good MTSP-1 substrates. Generally, the amino acid positions of MTSP-1 (based on chymotrypsin numbering) that contribute to extended specificity for substrate binding include: 146 and 151 (S1'); 189, 190, 191, 192, 216, 226 (S1); 57, 58, 59, 60, 61, 62, 63, 64, 99 (S2); 192, 217, 218, 146 (S3); 96, 97, 98, 99, 100, 168, 169, 170, 170A, 171, 172, 173, 174, 175, 176, 178. 179, 180, 215, 217, 224 (S4). Table 4 summarizes the residues in MTSP-1 for some of the amino acid positions important for specificity interactions with a targeted substrate. Typically, modification of an MTSP-1 protease to alter any one or more of the amino acids in the extended specificity binding pocket or other secondary sites of interaction affect the specificity or selectivity of a protease for a target substrate.

TABLE 4

Structural Determinants for MTSP-1 substrate cleavage (chymotrypsin numbering)
Residues that Determine Specificity

| S4 | | | | | S3 | | S2 | | | S1 | | | |
|---|---|---|---|---|---|---|---|---|---|---|---|---|---|
| | | | | Cys168 | | | | | 60's loop | | | | Cys191 |
| 171 | 174 | 180 | 215 | Cys182 | 192 | 218 | 99 | 57 | (58-64) | 189 | 190 | 226 | Cys220 |
| Leu | Gln | Met | Trp | 13* | Gln | Asp | Phe | His | 16* | Asp | Ser | Gly | yes |

*number of residues

3. Function/Activity

Membrane type serine protease 1 (MTSP-1) is a serine protease normally expressed in epithelial tissues, including the skin, and in kidney, lung, prostate and mammary epithelium (Kim et al. (1999) *Immunogenetics* 49:420-428; Oberst et al. (2001) *Am J Pathol* 158:1301-1311; Takeguchi et al. (1999) *Proc Natl Acad Sci* 96:11054-11061) and expressed in a variety of tumor types (Oberst et al. (2001) *Am J Pathol* 158:1301-1311). MTSP-1 is essential for post-natal survival; MTSP-1 deficient mice developed to term but died shortly thereafter and were characterized by aberrant skin development, implicating a role for MTSP-1 in epithelial and epidermal barrier function and as important for normal skin and hair development (List et al. (2002) *Oncogene* 23(23):2765-3779). Post-natal MTSP-1 ablation caused loss of tight junction formation and mislocalized tight-junction associated proteins in mutant animals (List et al. (2009) *Am J Patholo* 175:1453-1463), implicating MTSP-1 as essential in maintenance of mouse epithelia. MTSP-1 also is reported to promote neural progenitor cell migration (Kendall et al., (2008) *Stem Cells* 26(6):1575-86).

MTSP-1 is highly expressed or active in prostate, breast, lung, ovary and colorectal cancers and it may play a role in the metastasis of breast and prostate cancer. MTSP-1 also can be identified in blood vessels associated with tumors. MTSP-1 also is expressed in a variety of epithelial tissues with high levels of activity and/or expression in the human gastrointestinal tract and the prostate. MTSP-1 presence on the tumor or epithelial cell surface allows for interaction with a variety of factors and for proteolytic digestion of a broad range of substrates.

The role of MTSP-1 in cell migration on tumor activity may induce changes in the extracellular environment and the surrounding cells contributing to cell migration, progression, and metastasis. Because of the role of MTSP-1 in vascular diseases and cancer, MTSP-1 polypeptides provided herein are altered such that they exhibit reduced selectivity towards these proteins.

C. COMPLEMENT INHIBITION BY TARGETING C3

The modified MTSP-1 polypeptides provided herein exhibit increased specificity and/or activity for an inhibitory cleavage sequence in complement protein C3 compared to MTSP-1 polypeptides not containing the amino acid modifications (e.g., wild type human MTSP-1 (see, SEQ ID NO:1) or a reference full-length human MTSP-1 (see, SEQ ID NO:3) or the catalytic domain or protease domain thereof (see, SEQ ID NO:2 or 4)). The reference MTSP-1 polypeptides include the replacement C122S, by chymotrypsin numbering. Replacement with S at residue 122 does not alter specificity or activity on C3, but reduces aggregation. Since C3 is involved in the 3 initiation pathways of complement (see, e.g., FIG. 1), targeting C3 by proteolytic inhibition provides a general and broad therapeutic target for inactivation of the complement cascade. Inactivation cleavage of C3 blocks terminal activity of complement as well as the alternative pathway amplification loop. All three pathways converge at C3 (see, e.g., FIG. 1). By virtue of the ability to inhibit complement activation, such modified MTSP-1 polypeptides can be used to treat various diseases, conditions and pathologies associated with complement activation, such as inflammatory responses and autoimmune diseases. Complement activation is associated with the development of diseases and conditions by promoting local inflammation and damage to tissues caused in part by the generation of effector molecules and a membrane attack complex. In one example, such as in many autoimmune diseases, complement produces tissue damage because it is activated under inappropriate circumstances such as by antibody to host tissues. In other situations, complement can be activated normally, such as by septicemia, but still contributes to disease progression, such as in respiratory distress syndrome. Pathologically, complement can cause substantial damage to blood vessels (vasculitis), kidney basement membrane and attached endothelial and epithelial cells (nephritis), joint synovium (arthritis), and erythrocytes (hemolysis) if not adequately controlled. The role of C3 in complement activation is discussed in further detail below.

The modified MTSP-1 polypeptides herein can cleave C3. For example, A single intravenous injection of anti-C3 MTSP-1 variants can eliminate C3 from plasma in vivo; and similarly, a single intravitreal injection can cleave all C3 present in vitreous humor. Since C3 is the first component of the common complement pathway that is required for complement activation via all three "initiation" pathways (classical, alterative, and lectin), inactivation/elimination of C3 is functionally relevant for all three complement pathways.

1. Complement Protein C3 and its Role in Initiating Complement

The complement system involves over 30 soluble and cell-membrane bound proteins that function not only in the antibody-mediated immune response, but also in the innate immune response to recognize and kill pathogens such as bacteria, virus-infected cells, and parasites. Complement activation is initiated on pathogen surfaces through three distinct pathways: the classical pathway, the alternative pathway, and the lectin pathway. These pathways are distinct in that the components required for their initiation are different, but the pathways ultimately generate the same set of effector molecules (e.g., C3 convertases) which cleave complement protein C3 to trigger the formation of the membrane attack complex (MAC) (see, e.g., FIG. 1). Thus, complement protein C3 is an attractive target for a therapeutic since modulation of C3 results in modulation of various opsonins, anaphylatoxins and the MAC. Further, naturally occurring complement inhibitor proteins including factor H (FH), CR1, complement receptor Ig (CR1g), DAF and MCP inhibit at the C3 level.

There are three (3) pathways of complement activation (See, FIG. 1, which depicts these pathways). The pathways of complement are distinct; each relies on different molecules and mechanisms for initiation. The pathways are similar in that they converge to generate the same set of effector molecules, i.e., C3 convertases. In the classical and lectin pathways C4b2b acts as a C3 convertase; in the alternative pathway, C3bBb is a C3 convertase (see Table 5). Cleavage of C3 generates C3b, which acts as an opsonin and as the main effector molecule of the complement system for subsequent complement reactions, and C3a, which is a peptide mediator of inflammation. The addition of C3b to each C3 convertase forms a C5 convertase that generates C5a and C5b. C5a, like C3a, is a peptide mediator of inflammation. C5b mediates the "late" events of complement activation initiating the sequence of reactions culminating in the generation of the membrane attack complex (MAC). Although the three pathways produce different C3 and C5 convertases, all of the pathways produce the split products of C3 and C5 and form MAC. Alternatively, C3 can be cleaved and activated by extrinsic proteases, such as lysosomal enzymes and elastase (Markiewski and Lambris (2007) *Am J Patholo* 171:715-727; Ricklin and Lambris (2007) *Nat Biotechnol* 25:1265-1275).

TABLE 5

Complement Cascades

|  | Alternative Pathway | Classical Pathway | Lectin Pathway |
|---|---|---|---|
| Activators | Pathogen surface molecules LPS, teichoic acid, zymosan | antigen-bound IgM and IgG; non-immune molecules | Pathogens via recognition of carbohydrates on surface |
| C3 convertase | C3bBb | C4b2b | C4b2b |
| C5 convertase | C3bBb3b | C4b2b3b | C4b2b3b |
| MAC | C5678poly9 | C5678poly9 | C5678poly9 |
| anaphylatoxins | C3a, C5a | C3a, C4a, C5a | C3a, C4a, C5a | a. Classical Pathway

C1q is the first component of the classical pathway of complement. C1q is a calcium-dependent binding protein associated with the collectin family of proteins due to an overall shared structural homology (Malhotra et al., (1994) *Clin Exp Immunol.* 97(2):4-9; Holmskov et al. (1994) *Immunol Today* 15(2):67-74). Collectins, often called pattern recognition molecules, generally function as opsonins to target pathogens for phagocytosis by immune cells. In contrast to conventional collectins, such as MBL, the carboxy-terminal globular recognition domain of C1q does not have lectin activity but can serve as a "charged" pattern recognition molecule due to marked differences in the electrostatic surface potential of its globular domains (Gaboriaud et al. (2003) *J. Biol. Chem.* 278(47):46974-46982).

C1q initiates the classical pathway of complement in two different ways. First, the classical pathway is activated by the interaction of C1q with immune complexes (i.e. antigen-antibody complexes or aggregated IgG or IgM antibody) thus linking the antibody-mediated humoral immune response with complement activation. When the Fab portion (the variable region) of IgM or IgG binds antigen, the conformation of the Fc (constant) region is altered, allowing C1q to bind. C1q must bind at least 2 Fc regions to be activated. C1q, however, also is able to activate complement in the absence of antibody thereby functioning in the innate or immediate immune response to infection. Besides initiation by an antibody, complement activation also is achieved by the interaction of C1q with non-immune molecules such as polyanions (bacterial lipopolysaccharides, DNA, and RNA), certain small polysaccharides, viral membranes, C reactive protein (CRP), serum amyloid P component (SAP), and bacterial, fungal and virus membrane components.

C1q is part of the C1 complex which contains a single C1q molecule bound to two molecules each of the zymogens C1r and C1s. Binding of more than one of the C1q globular domains to a target surface (such as aggregated antibody or a pathogen), causes a conformational change in the (C1r:C1s)$_2$ complex which results in the activation of the C1r protease to cleave C1s to generate an active serine protease. Active C1s cleaves subsequent complement components C4 and C2 to generate C4b and C2b, which together form the C3 convertase of the classical pathway. The C3 convertase cleaves C3 into C3b, which covalently attaches to the pathogen surface and acts as an opsonin, and C3a, which stimulates inflammation. Some C3b molecules associate with C4b2b complexes yielding C4b2b3b which is the classical cascade C5 convertase. Table 6 summarizes the proteins involved in the classical pathway of complement.

TABLE 6

Proetins of the Classical Pathway

| Native Component | Active Form | Function of the Active Form |
|---|---|---|
| C1 (C1q:(C1r:C1s)$_2$) | C1q | Binds directly to pathogen surfaces or indirectly to antibody bound to pathogens |
|  | C1r | Cleaves C1s to an active protease |
|  | C1s | Cleaves C4 and C2 |
| C4 | C4b | Binds to pathogen and acts as an opsonin; binds C2 for cleavage by C1s |
|  | C4a | Peptide mediator of inflammation |
| C2 | C2b | Antive enzyme of classical pathway C3/C5 convertase; cleaves C3 and C5 |
|  | C2a | Precursor of vasoactive C2 kinin |
| C3 | C3b | Binds to pathogen surfaces and acts as an opsonin; initiates amplification via the alternative pathway; binds C5 for cleavage by C2b |
|  | C3a | Peptide mediator of inflammation | b. Alternative Pathway

The alternative pathway is initiated by foreign pathogens in the absence of antibody. Initiation of complement by the alternative pathway occurs through the spontaneous hydrolysis of C3 into C3b. A small amount of C3b is always present in body fluids, due to serum and tissue protease activity. Host self-cells normally contain high levels of membrane sialic acid which inactivate C3b if it binds, but bacteria contain low external sialic acid levels and thereby bind C3b without inactivating it. C3b on pathogen surfaces is recognized by the protease zymogen Factor B. Factor B is cleaved by Factor D. Factor D is the only activating protease of the complement system that circulates as an active enzyme rather than as a zymogen, but since Factor B is the only substrate for Factor D the presence of low levels of an active protease in normal serum is generally safe for the host. Cleavage of Factor B by Factor D yields the active product Bb which can associate with C3b to form C3bBb, the C3 convertase of the alternative pathway. Similar to the classical pathway, the C3 convertase produces more C3b and C3a from C3. C3b covalently attaches to the pathogen surface and acts as an opsonin and additionally initiates the alternative pathway, while C3a stimulates inflammation. Some C3b joins the complex to form C3bBb3b, the alternative pathway C5 convertase. C3bBb3b is stabilized by the plasma protein properdin or Factor P which binds to microbial surfaces and stabilizes the convertase. Table 7 summarizes the proteins involved in the alternative pathway of complement.

TABLE 7

Proteins of the Alternative Pathway

| Native Component | Active Form | Function of the Active Form |
|---|---|---|
| C3 | C3b | Binds to pathogen surface, binds Factor B for cleavage by Factor D |
| Factor B | Ba | Small fragment of Factor B, unknown function |
| | Bb | Active enzyme of the C3 convertase and C5 convertase |
| Factor D | D | Plasma serine protease, cleaves Factor B when it is bound to C3b to Ba and Bb |
| Factor P (properdin) | P | Plasma proteins with affinity for C3bBb convertase on bacterial cells; stabilizes convertase | c. Lectin Pathway

The lectin pathway (also referred to as the MBL pathway) is initiated following recognition and binding of pathogen-associated molecular patterns (PAMPs; i.e., carbohydrates moieties) by lectin proteins. Examples of lectin proteins that activate the lectin pathway of complement include mannose binding lectin (MBL) and ficolins (i.e. L-ficolin, M-ficolin, and H-ficolin). MBL is a member of the collectin family of proteins and thereby exists as an oligomer of subunits composed of identical polypeptide chains each of which contains a cysteine-rich, a collagen-like, a neck, and a carbohydrate-recognition or lectin domain. MBL acts as a pattern recognition molecule to recognize carbohydrate moieties, particularly neutral sugars such as mannose or N-acetylglucosamine (GlcNAc) on the surface of pathogens via its globular lectin domain in a calcium-dependent manner. MBL also acts as an opsonin to facilitate the phagocytosis of bacterial, viral, and fungal pathogens by phagocytic cells. Additional initiators of the lectin pathway include the ficolins including L-ficolin, M-ficolin, and H-ficolin (see e.g., Liu et al. (2005) *J Immunol.* 175:3150-3156). Similar to MBL, ficolins recognize carbohydrate moieties such as, for example, N-acetyl glucosamine and mannose structures.

The activation of the alternative pathway by MBL or ficolins is analogous to activation of the classical pathway by C1q whereby a single lectin molecule interacts with two protease zymogens. In the case of the lectin proteins, the zymogens are MBL-associated serine proteases, MASP-1 and MASP-2, which are closely homologous to the C1r and C1s zymogens of the classical pathway. Upon recognition of a PAMP by a lectin protein, such as for example by binding to a pathogen surface, MASP-1 and MASP-2 are activated to cleave C4 and C2 to form the MBL cascade C3 convertase. C3b then joins the complex to form the MBL cascade C5 convertase. MASP activation is implicated not only in responses to microorganisms, but in any response that involves exposing neutral sugars, including but not limited to tissue injury, such as that observed in organ transplants. Like the alternative cascade, the MBL cascade is activated independent of antibody; like the classical cascade, the MBL cascade utilizes C4 and C2 to form C3 convertase. Table 8 summarizes the proteins involved in the lectin pathway of complement.

TABLE 8

Proteins of the Lectin Pathway

| Native Component | Active Form | Function of the Active Form |
|---|---|---|
| MBL | MBL | Recognizes PAMPs, such as on pathogen surfaces (e.g., via recognition of carbohydrates) |
| Ficolins | L-Ficolin; M-Ficolin, or H-Ficolin | Recognizes PAMPs, such as on pathogen surfaces (e.g., via recognition of carbohydrates) |
| MASP-1 | MASP-1 | Cleaves C4 and C2 |
| MASP-2 | MASP-2 | Cleaves C4 and C2 | d. Complement-Mediated Effector Functions

Regardless of which initiation pathway is used, the end result is the formation of activated fragments of complement proteins (e.g. C3a, C4a, and C5a anaphylatoxins and C5b-9 membrane attack complexes), which act as effector molecules to mediate diverse effector functions. The recognition of complement effector molecules by cells for the initiation of effector functions (e.g. chemotaxis and opsonization) is mediated by a diverse group of complement receptors. The complement receptors are distributed on a wide range of cell types including erythrocytes, macrophages, B cells, neutrophils, and mast cells. Upon binding of a complement component to the receptor, the receptors initiate an intracellular signaling cascade resulting in cell responses such as stimulating phagocytosis of bacteria and secreting inflammatory molecules from the cell. For example, the complement receptors CR1 and CR2 which recognize C3b, C4b, and their products are important for stimulating chemotaxis. CR3 (CD11b/CD18) and CR4 (CD11c/CD18) are integrins that are similarly important in phagocytic responses but also play a role in leukocyte adhesion and migration in response to iC3b. The C5a and C3a receptors are G protein-coupled receptors that play a role in many of the pro-inflammatory-mediated functions of the C5a and C3a anaphylatoxins. For example, receptors for C3a, C3aR, exist on mast cells, eosinophils, neutrophils, basophils and monocytes and are directly involved in the pro-inflammatory effects of C3a.

Thus, through complement receptors, these complement effector molecule fragments mediate several functions including leukocyte chemotaxis, activation of macrophages, vascular permeability and cellular lysis (Frank, M. and Fries, L. Complement. In Paul, W. (ed.) Fundamental Immunology, Raven Press, 1989). A summary of some effector functions of complement products are listed in Table 9.

TABLE 9

Complement Effector Molecules and Functions

| Product | Activity |
| --- | --- |
| C2b (prokinin) | accumulation of body fluid |
| C3a (anaphylatoxin) | basophil and mast cell degranulation; enhanced vascular permeability; smooth muscle contraction; Induction of suppresor T cells |
| C3b and its products | opsonization; phagocyte activation |
| C4a (anaphylatoxin) | basophil & mast cell activation; smooth muscle contraction; enhanced vascular permeability |
| C4b | opsonization |
| C5a (anaphylatoxin; chemotactic factor) | basophil & mast cell activation; enhanced vascular permeability; smooth muscle contraction; chemotaxis; neutrophil aggregation; oxidative metabolism stimulation; stimulation of leukotriene release; induction of helper T-cells |
| C5b67 | chemotaxis; attachment to other cell membranes and lysis of bystander cells |
| C5b6789 (C5b-9) | lysis of target cells | i. Complement-Mediated Lysis: Membrane Attack Complex

The final step of the complement cascade by all three pathways is the formation of the membrane attack complex (MAC) (FIG. 1). C5 can be cleaved by any C5 convertase into C5a and C5b. C5b combines with C6 and C7 in solution, and the C5b67 complex associates with the pathogen lipid membrane via hydrophobic sites on C7. C8 and several molecules of C9, which also have hydrophobic sites, join to form the membrane attack complex, also called C5b6789 or C5b-9. C5b-9 forms a pore in the membrane through which water and solutes can pass, resulting in osmotic lysis and cell death. If complement is activated on an antigen without a lipid membrane to which the C5b67 can attach, the C5b67 complex can bind to nearby cells and initiate bystander lysis. A single MAC can lyse an erythrocyte, but nucleated cells can endocytose MAC and repair the damage unless multiple MACs are present. Gram negative bacteria, with their exposed outer membrane and enveloped viruses, are generally susceptible to complement-mediated lysis. Less susceptible are Gram positive bacteria, whose plasma membrane is protected by their thick peptidoglycan layer, bacteria with a capsule or slime layer around their cell wall, or viruses which have no lipid envelope. Likewise, the MAC can be disrupted by proteins that bind to the complex before membrane insertion such as Streptococcal inhibitor of complement (SIC) and clusterin. Typically, the MAC helps to destroy gram-negative bacteria as well as human cells displaying foreign antigens (virus-infected cells, tumor cells, etc.) by causing their lysis and also can damage the envelope of enveloped viruses.

ii. Inflammation

Inflammation is a process in which blood vessels dilate and become more permeable, thus enabling body defense cells and defense chemicals to leave the blood and enter the tissues. Complement activation results in the formation of several proinflammatory mediators such as C3a, C4a and C5a. The intact anaphylatoxins in serum or plasma are quickly converted into the more stable, less active C3a-desArg, C4a-desArg, or C5a-desArg forms, by carboxypeptidase N. C3a, C4a and C5a, and to a lesser extent their desArg derivatives, are potent bioactive polypeptides, termed anaphylatoxins because of their inflammatory activity. Anaphylatoxins bind to receptors on various cell types to stimulate smooth muscle contraction, increase vascular permeability, and activate mast cells to release inflammatory mediators. C5a, the most potent anaphylatoxin, primarily acts on white blood cells, particularly neutrophils. C5a stimulates leukocyte adherence to blood vessel walls at the site of infection by stimulating the increased expression of adhesion molecules so that leukocytes can squeeze out of the blood vessels and into the tissues, a process termed diapedesis. C5a also stimulates neutrophils to produce reactive oxygen species for extracellular killing, proteolytic enzymes, and leukotrienes. C5a also can further amplify the inflammatory process indirectly by inducing the production of chemokines, cytokines, and other proinflammatory mediators. C5a also interacts with mast cells to release vasodilators such as histamine so that blood vessels become more permeable. C3a also interacts with white blood cells, with major effects on eosinophils indicating a role for C3a in allergic inflammation. C3a induces smooth muscle contraction, enhances vascular permeability, and causes degranulation of basophils and release of histamine and other vasoactive substances. C2a can be converted to C2 kinin, which regulates blood pressure by causing blood vessels to dilate.

Although technically not considered an anaphylatoxin, iC3b, an inactive derivative of C3b, functions to induce leukocyte adhesion to the vascular endothelium and induce the production of the pro-inflammatory cytokine IL-1 via binding to its cell surface integrin receptors. C5b-9 also indirectly stimulates leukocyte adhesion, activation, and chemotaxis by inducing the expression of cell adhesion molecules such as E-selectin, and inducing interleukin-8 secretion (Bhole et al. (2003) *Crit Care Med* 31(1):97-104). C5b-9 also stimulates the release of secondary mediators that contribute to inflammation, such as for example, prostaglandin $E_2$, leukotriene $B_4$, and thromboxane.

Conversion of the human complement components C3 and C5 to yield their respective anaphylatoxin products has been implicated in certain naturally occurring pathologic states including: autoimmune disorders such as systemic lupus erythematosus, rheumatoid arthritis, malignancy, myocardial infarction, Purtscher's retinopathy, sepsis and adult respiratory distress syndrome. In addition, increased circulating levels of C3a and C5a have been detected in certain conditions associated with iatrogenic complement activation such as: cardiopulmonary bypass surgery, renal dialysis, and nylon fiber leukaphoresis.

iii. Chemotaxis

Chemotaxis is a process by which cells are directed to migrate in response to chemicals in their environment. In the immune response, a variety of chemokines direct the movement of cells, such as phagocytic cells, to sites of infection. For example, C5a is the main chemotactic factor for circulating neutrophils, but also can induce chemotaxis of monocytes. Phagocytes will move towards increasing concentrations of C5a and subsequently attach, via their CR1 receptors, to the C3b molecules attached to the antigen. The chemotactic effect of C5a, observed with basophils, eosinophils, neutrophils, and mononuclear phagocytes, is active at concentrations as low as $10^{-10}$ M.

iv. Opsonization

An important action of complement is to facilitate the uptake and destruction of pathogens by phagocytic cells. This occurs by a process termed opsonization whereby complement components bound to target bacteria interact with complement receptors on the surface of phagocytic cells such as neutrophils or macrophages. In this instance, the complement effector molecules are termed opsonins. Opsonization of pathogens is a major function of C3b and C4b. iC3b also functions as an opsonin. C3a and C5a increase the expression of C3b receptors on phagocytes and increase their metabolic activity.

C3b and, to a lesser extent, C4b help to remove harmful immune complexes from the body. C3b and C4b attach the immune complexes to CR1 receptors on erythrocytes. The erythrocytes then deliver the complexes to fixed macrophages within the spleen and liver for destruction. Immune complexes can lead to a harmful Type III hypersensitivity.

v. Activation of the Humoral Immune Response

Activation of B cells requires ligation of the B cell receptor (BCR) by antigen. It has been shown, however, that complement plays a role in lowering the threshold for B cell responses to antigen by up to 1000-fold. This occurs by the binding of C3d or C3dg, complement products generated from the breakdown fragments of C3, to CR2 receptors on B-lymphocytes which can co-ligate with the BCR. Co-ligation occurs when antigenic particles, such as for example immune complexes, opsonized with C3d bind the CR2 receptor via C3d as well as the BCR through antigen. Co-ligation of antigen complexes also can occur when C3d binds to antigens enhancing their uptake by antigen presenting cells, such as dendritic cells, which can then present the antigen to B cells to enhance the antibody response. Mice deficient in CR2 display defects in B cell function that result in reduced levels of natural antibody and impaired humoral immune responses.

2. C3 Structure and Function

The variant MTSP-1 polypeptides provided herein cleave complement protein C3 or its proteolytic fragments thereby inhibiting complement. Human complement protein C3 (Uniprot Accession No. P01024) is a 1663 amino acid single chain pre-proprotein having an amino acid sequence set forth in SEQ ID NO:9. The protein is encoded by a 41 kb gene located on chromosome 19 (nucleotide sequence set forth in SEQ ID NO:10). The pre-proprotein contains a 22 amino acid signal peptide (amino acids 1-22 of SEQ ID NO:9) and a tetra-arginine sequence (amino acids 668-671 of SEQ ID NO:9) that is removed by a furin-like enzyme resulting in formation of a mature two chain protein containing a beta chain (amino acids 23-667 of SEQ ID NO:9) and an alpha chain (amino acids 672-1663 of SEQ ID NO:9), that are linked by an interchain disulfide bond between amino acid residues Cys559 and Cys816. The mature 2 chain protein has a sequence of amino acids set forth in SEQ ID NO:16.

During the complement cascade, complement protein C3 is further processed by proteolytic cleavage to form various C3 proteolytic fragments. As described above, all three complement initiation pathways converge on the C3 convertases C4b2b and C3bBb. C3 convertases cleave C3 between residues 748 and 749 of SEQ ID NO:9 (see Table 10 below) generating the anaphylatoxin C3a (amino acids 672-748 of SEQ ID NO: 9) and the opsonin C3b (C3b alpha' chain; amino acids 749-1663 of SEQ ID NO: 9). C3a is involved in inflammation and C3b forms the C5 convertases ultimately leading to C5a anaphylatoxin and the MAC. The variant MTSP-1 polypeptides provided herein inhibit complement, and as such, do not cleave C3 at this GLAR cleavage site.

C3b has binding sites for various complement components including C5, properdin (P), factors H, B and I, complement receptor 1 (CR1) and the membrane co-factor protein (MCP) (see Sahu and Lambris (2001) *Immunological Reviews* 180:35-48). Binding of factor I, a plasma protease, in the presence of cofactors H, CR1 and MCP results in inactivation of C3b whereas binding of factors B and P in the presence of factor D results in amplification of C3 convertase and initiation of MAC. Factor I cleaves C3b in the presence of cofactors between residues 1303-1304, 1320-1321 and 954-955 of SEQ ID NO:9 (see Table 10 below) generating fragments iC3b (amino acids 749-1303 of SEQ ID NO: 9) and C3f (amino acids 1304-1320 of SEQ ID NO: 9). Factor I subsequently cleaves iC3b generating C3c (C3c alpha' chain fragment 1; amino acids 749-954 of SEQ ID NO: 9) and C3dg (amino acids 955-1303 of SEQ ID NO: 9). The end result is that C3b is permanently inactivated (see Sahu and Lambris (2001) *Immunological Reviews* 180:35-48). Since Factor I inactivates C3b, the factor I cleavage sites are ideal candidates for cleavage by the variant MTSP-1 polypeptides provided herein. Additional C3b proteolytic fragments include C3g (amino acids 955-1001 of SEQ ID NO: 9), C3d (amino acids 1002-1303 of SEQ ID NO: 9), and C3c alpha' chain fragment 2 (amino acids 1321-1663 of SEQ ID NO: 9). Cleavage sequences in complement protein C3 are set forth in Table 10 below, which lists the P4-P1 residues, the amino acid residues of the cleavage site (P1-P1' site) and the protease responsible for cleavage. The modified MTSP-1 polypeptides provided herein do not cleave at these sites.

TABLE 10

Complement Protein C3 Cleavage Sequences

| P4-P1 Residues | Cleavage Site (in SEQ ID NO:9) | Protease | SEQ ID NO |
|---|---|---|---|
| GLAR | 748-749 | C3 convertase | 17 |
| RLGR | 954-955 | Factor I | 18 |
| LPSR | 1303-1304 | Factor I | 19 |
| SLLR | 1320-1321 | Factor I | 20 | a. C3a

C3a (amino acids 672-748 of SEQ ID NO:9) is an anaphylatoxin that is involved in inflammation, basophil and mast cell degranulation, enhanced vascular permeability, smooth muscle contraction and induction of suppressor T cells.

b. C3b

C3b (amino acids 749-1663 of SEQ ID NO:9) has various roles in the complement cascade. C3b is an opsonin that facilitates the uptake and destruction of pathogens by phagocytic cells. Additionally, C3b combines with the C3 convertases to generate the C5 convertases which activate complement protein C5 thereby generating the C5a anaphylatoxin and C5b, which combines with C6, C7, C8 and C9 to form the membrane attack complex. Furthermore, as described in section 1b above, C3b is involved in the alternative pathway of complement initiation. C3b is regulated by complement regulatory protein Factor I, a plasma protease which degrades C3b into various fragments, including iC3b, C3c, C3d, C3f and C3dg, thereby permanently inactivating C3b.

C3b plays a critical role in complement-mediated effector functions by virtue of its ability to bind to the C3 convertases C4b2b and C3bBb thereby generating the C5 convertases C4b2b3b and C3bBb3b. The C5 convertases cleave the zymogen C5 into its active fragments, namely the C5a anaphylatoxin and C5b. C5a is involved in chemotaxis and inflammation and C5b is involved in formation of MAC.

i. Inhibitors of C3b

C3b has binding sites for various complement components including C5, properdin (P), factors H, B and I, complement receptor 1 (CR1) and the membrane co-factor protein (MCP) (see Sahu and Lambris (2001) *Immunological Reviews* 180:35-48). Binding of factor I, a plasma protease, in the presence of cofactors H, CR1 and MCP results in inactivation of C3b whereas binding of factors B and P in the presence of factor D results in amplification of C3 convertase and initiation of MAC. Factor I cleaves C3b in the presence of cofactors between residues 1303-1304, 1320-1321 and 954-955 of SEQ ID NO:9 generating fragments iC3b (amino acids 749-1303 of SEQ ID NO:9) and C3f (amino acids 1304-1320 of SEQ ID NO:9). Although technically not considered an anaphylatoxin, iC3b, an inactive derivative of C3b, functions to induce leukocyte adhesion to the vascular endothelium and induce the production of the pro-inflammatory cytokine IL-1 via binding to its cell surface integrin receptors. In addition, iC3b functions as an opsonin. Factor I subsequently cleaves iC3b generating fragments C3c (C3c alpha' chain fragment1: amino acids 749-954 of SEQ ID NO: 9 and C3c alpha' chain fragment 2: amino acids 1321-1663 of SEQ ID NO: 9) and C3dg (amino acids 955-1303 of SEQ ID NO: 9). The end result is that C3b is permanently inactivated (see Sahu and Lambris (2001) *Immunological Reviews* 180:35-48). C3dg can be further cleaved to generate fragments C3g (amino acids 955-1001 of SEQ ID NO: 9) and C3d (amino acids 1002-1303 of SEQ ID NO: 9).

D. MODIFIED MTSP-1 POLYPEPTIDES THAT CLEAVE C3

Provided herein are modified or variant membrane type-serine protease 1 (MTSP-1) polypeptides. The modified MTSP-1 polypeptides provided herein exhibit altered activities or properties compared to a wild-type, native or reference MTSP-1 polypeptide. For example, the MTSP-1 polypeptides provided herein contain modifications compared to a wild-type, native or reference MTSP-1 polypeptide set forth in any of SEQ ID NOS:1-4, or in a polypeptide that has at least 65%, 70%, 75%, 80%, 85%, 86%, 87%, 88%, 89%, 90%, 91%, 92%, 93%, 94%, 95%, 96%, 97%, 98%, or 99%, particularly at least 95%, sequence identity to any of SEQ ID NOS: 1-4, such as the reference MTSP-1 protease domain set forth in SEQ ID NO:4. Included among the modified MTSP-1 polypeptides provided herein are MTSP-1 polypeptides that alter (inhibit) complement activation by effecting inhibitory cleavage of complement protein C3. Among the modified MTSP-1 polypeptides provided herein are those that effect inhibitory cleavage of complement protein C3. Included are those that effect inhibitory cleavage of C3 with greater activity or specificity, $k_{cat}/K_m$, compared to a corresponding form of the MTSP-1 that does not contain the modification (the replacement, deletion and/or insertion) or compared to the corresponding form of unmodified MTSP-1 whose sequences are set forth in any of SEQ ID NOs:1-4. The modified MTSP-1 polypeptides also can have decreased specificity and/or and selectivity for substrates and targets cleaved or recognized by unmodified MTSP-1 compared to a MTSP-1 polypeptide not containing the amino acid modification(s), such as, for example, proteinase-activated receptor-2 (PAR-2), urokinase-type plasminogen activator (uPA), and/or hepatocyte growth factor (HGF).

The modified MTSP-1 polypeptides provided herein inhibit or inactivate complement through inhibitory or inactivation cleavage of complement protein C3. The modified MTSP-1 polypeptides provided herein inhibit or inactivate complement by cleaving complement protein C3 at a cleavage site that results in inhibition or inactivation of C3. Inactivation or inhibition cleavage of complement protein C3 can be at any sequence in C3 so long as the resulting cleavage of C3 results in inactivation or inhibition of activation of complement. Since the modified MTSP-1 polypeptides provided herein inhibit complement activation, the modified MTSP-1 polypeptides do not effect cleavage of the zymogen form of C3 to generate the C3a and C3b activated fragments. Thus, modified MTSP-1 polypeptides provided herein do not cleave C3 between residues 748-749 of SEQ ID NO: 9, which would result in generation of C3a and C3b. Inhibition or inactivation cleavage sites of complement protein C3 can be empirically determined or identified. If necessary, a modified MTSP-1 polypeptide provided herein can be tested for its ability to inhibit complement as described in section E below and as exemplified in the Examples.

The modified MTSP-1 polypeptides provided herein are isolated protease domains of MTSP-1. Smaller portions thereof that retain protease activity also are contemplated. The protease domains provided herein are single-chain polypeptides with an N-terminus generated at the cleavage site (generally having the consensus sequence R↓VVGG, R↓IVGG, R↓IVNG, R↓ILGG, R↓VGLL, R↓ILGG or a variation thereof; an N-terminus R↓V or R↓I, where the arrow represents the cleavage point) when the zymogen is activated.

The protease domains generated herein, however, do not result from activation, which produces a two chain activated product, but rather are single chain polypeptides with the N-terminus include the consensus sequence ↓VVGG, ↓IVGG, ↓VGLL, ↓ILGG or ↓IVNG or other such motif at the N-terminus. As shown herein, such polypeptides, although not the result of activation and not double-chain forms, exhibit proteolytic (catalytic) activity. These protease domain polypeptides are used in assays to screen for agents that modulate the activity of the MT-SP. Such assays are also provided herein. In exemplary assays, the effects of test compounds in the ability of a protease domains to proteolytically cleave a known substrate, typically a fluorescently, chromogenically or otherwise detectably labeled substrate, are assessed. Agents, generally compounds, particularly small molecules, that modulate the activity of the protease domain are candidate compounds for modulating the activity of the MT-SP. The protease domains can also be used to produce single-chain protease-specific antibodies. The protease domains provided herein include, but are not limited to, the single chain region having an N-terminus at the cleavage site for activation of the zymogen, through the C-terminus, or C-terminal truncated portions thereof that exhibit proteolytic activity as a single-chain polypeptide in in vitro proteolysis assays, of any MT-SP family member, preferably from a mammal, including and most preferably human, such as, for example, MTSP-1.

The modified MTSP-1 polypeptides provided herein are mutants of the single chain protease domain of MTSP-1, particularly modified MTSP-1 polypeptides in which the Cys residue in the protease domain that is free (i.e., does not form disulfide linkages with any other Cys residue in the protein) is substituted with another amino acid substitution, preferably with a conservative amino acid substitution or a substitution that does not eliminate the activity, such as, for example, substitution with Serine, and modified MTSP-1 polypeptides in which a glycosylation site(s) is eliminated. Modified MTSP-1 polypeptides in which other conservative amino acid substitutions in which catalytic activity is retained are also contemplated (see, e.g., Table 3, for exemplary amino acid substitutions).

The modified MTSP-1 polypeptides provided herein catalyze inhibitory or inactivation cleavage of complement protein C3. The modified MTSP-1 polypeptides provided herein cleave complement protein C3 at any cleavage sequence as long as the resulting C3 fragments are inactive, or unable to activate a complement-mediated effector function. The modified MTSP-1 polypeptides provided herein include those that have altered (i.e., decreased) specificity and/or selectivity for natural targets of MTSP-1. In one example, the modified MTSP-1 polypeptides provided herein have reduced selectivity for PAR-2, uPA and/or HGF. In other examples, the modified MTSP-1 polypeptides provided herein have increased specificity for cleavage of complement protein C3, and decreased specificity for PAR-2, uPA and/or HGF.

The modified MTSP-1 polypeptides provided herein contain one or more amino acid modifications such that they cleave complement protein C3 in a manner that results in inactivation or inhibition of complement. The modifications can be a single amino acid modification, such as single amino acid replacements (substitutions), insertions or deletions, or multiple amino acid modifications, such as multiple amino acid replacements, insertions or deletions. Exemplary modifications are amino acid replacements, including single or multiple amino acid replacements. The amino acid replacement can be a conservative substitution, such as set forth in Table 3, or a non-conservative substitution, such as any described herein. Modified MTSP-1 polypeptides provided herein can contain at least or 1, 2, 3, 4, 5, 6, 7, 8, 9, 10, 11, 12, 13, 14, 15, 16, 17, 18, 19, 20, or more modified positions compared to the MTSP-1 polypeptide not containing the modification.

The modifications described herein can be made in any MTSP-1 polypeptide. For example, the modifications are made in a human MTSP-1 polypeptide having a sequence of amino acids including or set forth in SEQ ID NO:1, SEQ ID NO:2, SEQ ID NO:3, or SEQ ID NO:4; a mouse MTSP-1 polypeptide having a sequence of amino acids including or set forth in SEQ ID NO:12; or a rat MTSP-1 polypeptide having a sequence of amino acids including or set forth in SEQ ID NO:13; or in sequence variants or catalytically active fragments that exhibit at least 65%, 70%, 75%, 80%, 85%, 86%, 87%, 88%, 89%, 90%, 91%, 92%, 93%, 94%, 95%, 96%, 97%, 98%, 99% or more sequence identity to any of SEQ ID NOS:1-4, 12 and 13.

The modified MTSP-1 polypeptides provided herein can be modified in any region or domain of a MTSP-1 polypeptide provided herein, as long as the modified MTSP-1 polypeptide retains its ability to effect inactivation or inhibitory cleavage of complement protein C3. The modified MTSP-1 polypeptides provided herein can be single-chain or two chain polypeptides, species variants, splice variants, allelic variants, isoforms, or catalytically active fragments thereof, such as, for example, the protease domain thereof. The MTSP-1 polypeptides provided herein can be full length or truncated MTSP-1 polypeptides. The modified MTSP-1 polypeptides provided herein can be the protease domain of MTSP-1 or a modified form of the protease domain of MTSP-1. Also contemplated for use herein are zymogen, precursor or mature forms of modified MTSP-1 polypeptides, provided the MTSP-1 polypeptides retain their ability to effect inhibitory or inactivation cleavage of complement protein C3. Modifications in a MTSP-1 polypeptide also can be made to a MTSP-1 polypeptide that also contains other modifications, including modifications of the primary sequence and modifications not in the primary sequence of the polypeptide. For example, modifications described herein can be in a MTSP-1 polypeptide that is a fusion polypeptide or chimeric polypeptide. The modified MTSP-1 polypeptides provided herein also include polypeptides that are conjugated to a polymer, such as a PEG reagent.

For purposes herein, reference to positions and amino acids for modification, including amino acid replacement or replacements, herein are with reference to the MTSP-1 polypeptide set forth in any of SEQ ID NOs:1-4. It is within the level of one of skill in the art to make any of the modifications provided herein in another MTSP-1 polypeptide by identifying the corresponding amino acid residue in another MTSP-1 polypeptide, such as the MTSP-1 polypeptide set forth in any of SEQ ID NOs:1-4 or a variant thereof that exhibits at least 70%, 75%, 80%, 85%, 86%, 87%, 88%, 89%, 90%, 91%, 92%, 93%, 94%, 95%, 96%, 97%, 98%, 99% or more sequence identity to a MTSP-1 polypeptide set forth in any of SEQ ID NOs:1-4. Corresponding positions in another MTSP-1 polypeptide can be identified by alignment of the MTSP-1 polypeptide with the reference a MTSP-1 polypeptide set forth in any of SEQ ID NOs:1-4. For purposes of modification (e.g., amino acid replacement), the corresponding amino acid residue can be any amino acid residue, and need not be identical to the residue set forth in any of SEQ ID NOs:1-4. Typically, the corresponding amino acid residue identified by alignment with, for example, residues in SEQ ID NO:4 is an amino acid residue that is identical to SEQ ID NO:4, or is a conservative or semi-conservative amino acid residue thereto. It is also understood that the exemplary replacements provided herein can be made at the corresponding residue in a MTSP-1 polypeptide, such as the protease domain of MTSP-1, so long as the replacement is different than exists in the unmodified or reference form of the MTSP-1 polypeptide, such as the protease domain of MTSP-1. Based on this description and the description elsewhere herein, it is within the level of one of skill in the art to generate a modified MTSP-1 polypeptide containing any one or more of the described mutations, and test each for a property or activity as described herein.

The modified MTSP-1 polypeptides provided herein alter complement activity by proteolysis-mediated inhibition or inactivation of complement protein C3. The modified MTSP-1 provided herein can have decreased specificity for a MTSP-1 substrate, such as, for example, proteinase-activated receptor-2 (PAR-2), urokinase-type plasminogen activator (uPA), and/or hepatocyte growth factor (HGF). For example, the modified MTSP-1 polypeptides provided herein exhibit less than 100% of the wild type activity of a MTSP-1 polypeptide for cleavage of proteinase-activated receptor-2 (PAR-2), urokinase-type plasminogen activator (uPA), and/or hepatocyte growth factor (HGF), such as less than 90%, 80%, 70%, 60%, 50%, 40%, 30%, 20%, 10% or less of the activity for cleavage of proteinase-activated receptor-2 (PAR-2), urokinase-type plasminogen activator (uPA), and/or hepatocyte growth factor (HGF) of a wild type or reference MTSP-1 polypeptide, such as the corresponding polypeptide not containing the amino acid modification. In another example, the modified MTSP-1 polypeptides provided herein exhibit less than 100% of the wild type binding activity of a MTSP-1 polypeptide for PAR-2, uPA and/or HGF, such as less than 90%, 80%, 70%, 60%, 50%, 40%, 30%, 20%, 10% or less of the activity for binding to PAR-2, uPA and/or HGF of a wild type or reference MTSP-1 polypeptide, such as the corresponding polypeptide not containing the amino acid modification.

Also provided herein are nucleic acid molecules that encode any of the modified MTSP-1 polypeptides provided herein. Nucleic acid molecules that encode a single-chain protease domain or catalytically active portion thereof also are provided. In some examples, the encoding nucleic acid molecules also can be modified to contain a heterologous signal sequence to alter (e.g., increased) expression and secretion of the polypeptide. The modified MTSP-1 polypeptides and encoding nucleic acid molecules provided herein can be produced or isolated by any method known in the art including isolation from natural sources, isolation of recombinantly produced proteins in cells, tissues and organisms, and by recombinant methods and by methods including in silico steps, synthetic methods and any methods known to those of skill in the art. The modified polypeptides and encoding nucleic acid molecules provided herein can be produced by standard recombinant DNA techniques known to one of skill in the art. Any method known in the art to effect mutation of any one or more amino acids in a target protein can be employed. Methods include standard site-directed or random mutagenesis of encoding nucleic acid molecules, or solid phase polypeptide synthesis methods. For example, nucleic acid molecules encoding a MTSP-1 polypeptide can be subjected to mutagenesis, such as random mutagenesis of the encoding nucleic acid, error-prone PCR, site-directed mutagenesis, overlap PCR, gene shuffling, or other recombinant methods. The nucleic acid encoding the polypeptides can then be introduced into a host cell to be expressed heterologously. Hence, also provided herein are nucleic acid molecules encoding any of the modified polypeptides provided herein. In some examples, the modified MTSP-1 polypeptides are produced synthetically, such as using solid phase or solutions phase peptide synthesis.

The MTSP-1 polypeptides provided herein have been modified to have increased specificity and/or selectivity for cleavage of an inhibitory or inactivation cleavage sequence of complement protein C3. MTSP-1 polypeptides can be modified using any method known in the art for modification of proteins. Such methods include site-directed and random mutagenesis. Assays such as the assays for biological function of complement activation provided herein and known in the art can be used to assess the biological function of a modified MTSP-1 polypeptide to determine if the modified MTSP-1 polypeptide targets complement protein C3 for cleavage and inactivation. Exemplary methods to identify an MTSP-1 polypeptide and the modified MTSP-1 polypeptides are provided herein.

1. Exemplary Modified MTSP-1 Polypeptides

Provided herein are modified MTSP-1 polypeptides that contain one more, including 2, 3, 4, 5, 6, 7, 8, 9, 10, 11, 12, 13, 14, 15 and more amino acid modifications in a MTSP-1 polypeptide and that cleave complement protein C3 such that complement is inhibited or inactivated. Modifications are in the primary amino acid sequence, and include replacements, deletions and insertions of amino acid residues. The modification alters the specificity/activity of the MTSP-1 polypeptide. The modified MTSP-1 polypeptides herein are designed or selected to recognize and cleave a target site in a complement protein, particularly C3 in a site that inactivates C3. They also can be further modified and screened to have reduced specificity/activity on in vivo natural substrates and/or to cleave such substrates less than an unmodified wild-type MTSP-1 polypeptide. They can be selected and identified by any suitable protease screening method. The modified MTSP-1 polypeptides herein initially were identified using the screening method described in U.S. Pat. No. 8,211,428, in which a library of modified proteases are reacted with a cognate or other inhibitory serpin, such as ATIII that is modified to include a target sequence in the reactive site loop to capture modified proteases that would cleave such target.

Modified MTSP-1 polypeptides provided herein display increased activity or specificity or $k_{cat}/K_m$ for complement protein C3 at a site that inactivates C3, and also can have reduced activity or specificity and/or display increased selectivity, specificity and/or activity for a target site on complement protein C3, whereby the modified MTSP-1 polypeptide inactivates C3. The modified MTSP-1 polypeptides exhibit increased activity for cleaving and inactivating C3 compared to the corresponding form of wild-type or wild-type with the replacement C122S (by chymotrypsin numbering). In particular, the protease domain of the modified polypeptide exhibits increased inactivation cleavage activity of C3 compared to the MTSP-1 protease domain of SEQ ID NO:4 (MTSP-1 protease domain with C122S). The increase in activity can be 10%, 20%, 50%, 100%, 1-fold, 2-fold, 3-fold, 4, 5, 6, 7, 8, 9, 10-fold and more compared to the unmodified MTSP-1.

For example, the modified MTSP-1 polypeptide can exhibit 110-1000% or more of the MTSP-1 activity of a wild type or reference MTSP-1 polypeptide, such as the MTSP-1 polypeptide set forth in any of SEQ ID NOs:1-4 for inactivating C3. For example, modified MTSP-1 polypeptides provided herein exhibit 110%, 120%, 130%, 140%, 150%, 160%, 170%, 180%, 190%, 200%, 250%, 300%, 400%, 500%, 600%, 700%, 800%, 900%, 1000% or more of the activity of the unmodified or reference MTSP-1 polypeptide, such as the corresponding polypeptide not containing the amino acid modification (e.g. amino acid replacement), for example, a MTSP-1 protease domain set forth in any of SEQ ID NOs:1-4. For example, exemplary positions that can be modified, for example by amino acid replacement or substitution, include, but are not limited to, any of positions corresponding to position 637, 640, 658, 661, 664, 666, 705, 706, 707, 708, 731, 759, 783, or 801 with reference to the sequence of amino acids set forth in SEQ ID NO:1 (corresponding to positions 38, 41, 59, 60b, 60e, 60g, 96, 97, ins97a, 98, 99, 122, 151, 175, 192 according to chymotrypsin numbering). For example, the amino acid positions can be replacements at positions corresponding to replacement of glutamine (Q) at position 637, I640, Y658, D661, F664, Y666, D705, F706, T707, F708, C731, G759, Q783, or C801 with reference to amino acid positions set forth in SEQ ID NO:1 (corresponding to Q38, I41, Y59, D60b, F60e, Y60g, D96, F97, T98, F99, C122, G151, Q175, C191 according to chymotrypsin numbering).

Exemplary amino acid replacements at any of the above positions are set forth in Table 11. Reference to corresponding position in Table 11 is with reference to positions set forth in SEQ ID NO:1. It is understood that the replacements can be made in the corresponding position in another MTSP-1 polypeptide by alignment with the sequence set forth in SEQ ID NO:1, whereby the corresponding position is the aligned position. For example, the replacement can be made in the MTSP-1 protease domain with the sequence set forth in SEQ ID NO: 2 or a reference MTSP-1 protease domain with the sequence set forth in SEQ ID NO: 4. In some examples, the amino acid replacement(s) can be at the corresponding position in a MTSP-1 polypeptide as set forth in SEQ ID NO: 4 or a variant thereof having at least or at least about 75%, 80%, 81%, 82%, 83%, 84%, 85%, 86%, 86%, 88%, 89%, 90%, 91%, 92%, 93%, 94%, 95%, 96%, 97%, 98%, 99%, particularly 95%, or more sequence identity thereto, so long as the resulting modified MTSP-1 polypeptide exhibits altered (i.e., enhanced) specificity towards complement protein C3 compared to a reference MTSP-1 polypeptide. In one example, any one or more of the replacements are in any of SEQ ID NOs:1-4, so long as the resulting modified MTSP-1 polypeptide exhibits altered (i.e., enhanced) specificity towards complement protein C3 compared to a reference MTSP-1 polypeptide, such as, for example, a reference MTSP-1 polypeptide set forth in any of SEQ ID NOs: 1-4.

TABLE 11

Active Variants

| Corresponding Position (in SEQ ID NO:1) | Corresponding Position (chymotrypsin numbering) | Replacement |
| --- | --- | --- |
| 637 | 38 | H |
| 640 | 41 | S, R, A, D |
| 658 | 59 | F |
| 661 | 60b | T, V |
| 664 | 60e | S, R K |
| 666 | 60g | W |
| 705 | 96 | K, V, Y, L, I, P, E |
| 706 | 97 | G, T, E, D, N, Y, W |
|  | 97a | Insertion of V, E, A, G, N |
| 707 | 98 | P, G, N |
| 708 | 99 | L |
| 731 | 122 | S |
| 759 | 151 | H, N |
| 783 | 175 | L |
| 801 | 192 | D, E, T |

Exemplary of amino acid modifications in the modified MTSP-1 polypeptides provided herein include, but are not limited to, replacement with histidine (H) at a position corresponding to position 38; S at a position corresponding to position 41; R at a position corresponding to position 41; A at a position corresponding to position 41; D at a position corresponding to position 41; F at a position corresponding to position 59; T at a position corresponding to position 60b; V at a position corresponding to position 60b; S at a position corresponding to position 60e; R at a position corresponding to position 60e; K at a position corresponding to position 60e; W at a position corresponding to position 60g; K at a position corresponding to position 96; V at a position corresponding to position 96; Y at a position corresponding to position 96; L at a position corresponding to position 96; I at a position corresponding to position 96; P at a position corresponding to position 96; E at a position corresponding to position 96; G at a position corresponding to position 97; T at a position corresponding to position 97; E at a position corresponding to position 97; D at a position corresponding to position 97; N at a position corresponding to position 97; Y at a position corresponding to position 97; W at a position corresponding to position 97; V at a position corresponding to position 97a; E at a position corresponding to position 97a; A at a position corresponding to position 97a; G at a position corresponding to position 97a; N at a position corresponding to position 97a; P at a position corresponding to position 98; G at a position corresponding to position 98; N at a position corresponding to position 98; L at a position corresponding to position 99; S at a position corresponding to position 122; H at a position corresponding to position 151; N at a position corresponding to position 151; L at a position corresponding to position 175; D at a position corresponding to position 192; E at a position corresponding to position 192; T at a position corresponding to position 192, according to chymotrypsin numbering each with reference to the amino acid positions set forth in SEQ ID NOs:1 or 3. S at a position corresponding to position 731 (122 S at a position corresponding to position 731) replaces a free Cys to thereby reduce a tendency for aggregation.

Exemplary modified MTSP-1 polypeptides containing amino acid modifications are set forth in Table 12a below. Table 12b includes mature numbering for exemplary modified MTSP-1 polypeptides. The Sequence ID No. references an exemplary MTSP-1 protease domain that contains the recited replacements, which include the replacement at C122S to reduce or eliminate aggregation. C122 is a free cysteine, which can result in cross-linking among the protease polypeptides; this replacement, while advantageous, is optional. It is understood, that the referenced (by SEQ ID NO.) protease domain is exemplary, and full-length and precursor molecules, as well as other catalytically active portions of the protease domain, full-length and precursor polypeptide can include the recited replacements.

TABLE 12a

Modified MTSP-1 Polypeptides

| Chymotrypsin numbering | SEQ ID NO |
| --- | --- |
| I41R/F97T/Ins97aE/T98G/F99L/C122S/G151N/Q175L/Q192E | 21 |
| Q38H/I41A/D60bV/F60eR/Y60gW/F97T/ins97aE/T98G/F99L/C122S/G151N/Q175L/Q192D | 22 |
| Q38H/I41A/D60bT/F60eK/Y60gW/F97T/ins97aE/T98G/F99L/C122S/G151N/Q175L/Q192D | 23 |
| Q38H/I41S/D60bT/F60eS/Y60gW/F97D/ins97aV/T98P/F99L/C122S/G151H/Q175L/Q192E | 24 |
| Q38H/I41S/D60bT/F60eS/Y60gW/F97D/ins97aV/T98P/F99L/C122S/G151H/Q175L/Q192D | 25 |
| Q38H/I41A/D60bT/F60eK/Y60gW/F97T/ins97aE/T98G/F99L/C122S/G151H/Q175L/Q192D | 26 |
| Q38H/I41S/D60bT/F60eS/Y60gW/F97D/ins97aV/T98P/F99L/C122S/G151N/Q175L/Q192D | 27 |
| Q38H/I41A/D60bV/F60eR/Y60gW/F97T/ins97aE/T98G/F99L/C122S/G151H/Q175L/Q192D | 28 |
| Q38H/I41A/D60bV/F60eR/Y60gW/D96I/F97Y/ins97aN/T98G/F99L/C122S/G151N/Q175L/Q192D | 29 |
| Q38H/I41S/D60bT/F60eS/Y60gW/D96K/F97D/ins97aA/T98P/F99L/C122S/G151H/Q175L/Q192D | 30 |
| Q38H/I41A/D60bV/F60eR/Y60gW/D96P/F97W/ins97aN/T98G/F99L/C122S/G151N/Q175L/Q192E | 31 |
| Q38H/I41A/D60bV/F60eR/Y60gW/D96I/F97N/T98G/F99L/C122S/G151N/Q175L/Q192D | 32 |

TABLE 12a-continued

Modified MTSP-1 Polypeptides

| Chymotrypsin numbering | SEQ ID NO |
|---|---|
| Q38H/I41S/D60bT/F60eS/Y60gW/D96Y/F97E/ins97aV/T98G/F99L/C122S/G151H/Q175L/Q192D | 33 |
| Q38H/I41S/D60bT/F60eS/Y60gW/D96L/F97D/ins97aG/T98N/F99L/C122S/G151H/Q175L/Q192E | 34 |
| Q38H/I41S/D60bT/F60eS/Y60gW/D96K/F97G/ins97aV/T98P/F99L/C122S/G151H/Q175L/Q192D | 35 |
| Q38H/I41S/D60bT/F60eS/Y60gW/D96V/F97G/ins97aV/T98P/F99L/C122S/G151H/Q175L/Q192D | 36 |
| Q38H/I41S/D60bT/F60eS/Y60gW/D96K/F97D/ins97aA/T98P/F99L/C122S/G151N/Q175L/Q192D | 37 |
| Q38H/I41S/D60bT/F60eS/Y60gW/F97G/ins97aV/T98P/F99L/C122S/G151H/Q175L/Q192D | 38 |
| Q38H/I41S/D60bT/F60eS/Y60gW/D96K/ins97aV/T98P/F99L/C122S/G151H/Q175L/Q192D | 39 |
| Q38H/I41S/D60bT/F60eS/Y60gW/D96K/F97G/ins97aV/T98P/F99L/C122S/G151H/Q175L | 40 |
| I41E/F99L/C122S/G151N/Q192T | 41 |
| I41D/C122S/G151N/Q192T | 42 |
| I41S/F99L/C122S/G151N/Q192V | 43 |
| I41F/F99L/C122S/G151N/Q192T | 44 |
| I41D/Y59F/D96E/F99L/C122S/G151N/Q192T | 45 |
| I41D/Y59F/C122S/G151N/Q192T | 46 |
| I41S/D60bT/F60eS/Y60gW/D96K/F97G/ins97aV/T98P/F99L/C122S/G151H/Q175L/Q192D | 47 |
| Q38H/D60bT/F60eS/Y60gW/D96K/F97G/ins97aV/T98P/F99L/C122S/G151H/Q175L/Q192D | 48 |
| Q38H/I41S/F60eS/Y60gW/D96K/F97G/ins97aV/T98P/F99L/C122S/G151H/Q175L/Q192D | 49 |
| Q38H/I41S/D60bT/Y60gW/D96K/F97G/ins97aV/T98P/F99L/C122S/G151H/Q175L/Q192D | 50 |
| Q38H/I41S/D60bT/F60eS/D96K/F97G/ins97aV/T98P/F99L/C122S/G151H/Q175L/Q192D | 51 |
| Q38H/I41S/D60bT/F60eS/Y60gW/D96K/F97G/T98P/F99L/C122S/G151H/Q175L/Q192D | 52 |
| Q38H/I41S/D60bT/F60eS/Y60gW/D96K/F97G/ins97aV/F99L/C122S/G151H/Q175L/Q192D | 53 |
| Q38H/I41S/D60bT/F60eS/Y60gW/D96K/F97G/ins97aV/T98P/C122S/G151H/Q175L/Q192D | 54 |
| Q38H/I41S/D60bT/F60eS/Y60gW/D96K/F97G/ins97aV/T98P/F99L/C122S/Q175L/Q192D | 55 |
| Q38H/I41S/D60bT/F60eS/Y60gW/D96K/F97G/ins97aV/T98P/F99L/C122S/G151H/Q192D | 56 |
| Q38H/I41S/D96K/F97G/ins97aV/T98P/F99L/C122S/Q192D | 57 |
| I41S/D96K/F97G/ins97aV/T98P/F99L/C122S/Q175L/Q192D | 58 |
| Q38H/I41S/D96K/F97G/ins97aV/T98P/F99L/C122S/Q175L/Q192D | 59 |
| I41S/D96K/F97G/ins97aV/T98P/F99L/C122S/Q192D | 63 |
| Q38H/I41S/D96K/F97G/ins97aV/T98P/F99L/C122S/Q175L/Q192D | 64 |
| Q38H/I41S/D60bY/D96K/F97G/ins97aV/T98P/F99L/C122S/Q192D/D217V | 65 |
| I41S/D96K/F97G/ins97aV/T98P/F99L/C122S/Q192G/D217V | 66 |
| I41S/D60bY/D96K/F97G/ins97aV/T98P/F99L/C122S/Q192D/D217V | 67 |
| I41S/D96M/F97G/ins97aV/T98P/F99L/C122S/Q192G/D217V | 68 |
| I41S/D96K/F97G/ins97aV/T98P/F99L/C122S/Q192V/D217I | 69 |
| I41S/D96K/F97G/ins97aV/T98P/F99L/C122S/Q192H | 70 |
| I41S/D96K/F97G/ins97aV/T98P/F99L/C122S/Q192N/D217V | 71 |
| I41S/D60bY/D96K/F97G/ins97aV/T98P/F99L/C122S/Q175L/Q192D | 72 |
| Q38H/I41S/D96K/F97G/ins97aV/T98P/F99L/C122S/Q192G/D217V | 73 |
| I41S/D96K/F97G/ins97aV/T98P/F99L/C122S/Q175L/Q192V | 74 |
| I41S/P49S/D96K/F97G/ins97aV/T98P/F99L/C122S/Q192G/D217V | 75 |
| I41S/D96K/F97G/ins97aV/T98P/F99L/C122S/Q175L/Q192N/D217V | 76 |
| I41T/F97W/F99L/C122S/G151N/Q175M/Q192G/D217L | 77 |
| I41G/F97L/F99L/C122S/Q175A/Q192T/D217V | 78 |
| I41G/F97V/F99L/C122S/G151Q/Q175M/Q192A/D217L | 79 |
| I41G/F97I/F99L/C122S/G151L/Q175M/Q192S/D217V | 80 |
| I41G/F97S/F99L/C122S/G151N/Q175L/Q192G/D217I | 81 |
| F97E/F99L/C122S/D217I/K224N | 154 |
| C122S/G193A | 155 |
| C122S/G193E | 156 |
| D96_F97delinsWYY/T98P/F99L/C122S | 157 |
| F97D/F99L/C122S/Q192G | 158 |
| H40R/I41H/F97D/F99L/C122S/Q192G | 159 |
| C122S/G151N/G193A | 160 |
| H40R/I41H/C122S/G151N | 161 |
| H40R/I41H/F97D/C122S/G151N | 162 |
| H40R/I41H/F97E/C122S | 163 |
| F97T/ins97aE/T98G/F99L/C122S/Q175L/Q192E | 164 |

TABLE 12a-continued

Modified MTSP-1 Polypeptides

| Chymotrypsin numbering | SEQ ID NO |
|---|---|
| H40R/I41H/Y60gL/F97D/F99L/C122S/G151N/Q175M/D2171/K224S | 165 |
| H40R/I41H/F97D/F99L/C122S/G151D/Q192G | 166 |
| H40R/I41H/F97D/F99L/Q192G | 167 |
| H40R/I41H/Y60gH/F97D/F99L/C122S/G151N/Q175A/Q192H/D2171/K224R | 168 |
| H40R/I41H/Y60gF/F97D/F99L/C122S/Q192G/D217M/K224R | 169 |
| H40R/I41H/Y60gF/F97D/F99L/C122S/Q192G/D217R/K224A | 170 |
| H40R/I41H/F97D/F99L/C122S/Q175L/Q192G/D217K/K224A | 171 |
| H40R/I41H/F97D/F99L/C122S/Q175M/Q192G/D217V/K224Y | 172 |
| H40R/I41H/F97D/F99L/C122S/Q175K/Q192G/D2171/K224H | 173 |
| H40R/I41H/F97D/F99L/C122S/Q175M/Q192G/D217S | 174 |
| H40R/I41H/Y60gF/F97D/F99L/C122S/Q175M/Q192G/D217W/K224R | 175 |
| H40R/I41H/Y60gN/F97D/F99L/C122S/G151N/Q175K/Q192S/D217S/K224L | 176 |
| H40R/I41H/Y60gH/F97D/F99L/C122S/Q175M/Q192G/D2171/K224L | 177 |
| H40K/I41L/Y60gF/F97D/F99L/C122S/G151N/Q175R | 178 |
| H40R/I41H/Y60gL/F97D/F99L/C122S/G151N | 179 |
| H40K/I41M/Y60gG/F97D/F99L/C122S/G151N/Q175R/Q192R/D217V/K224S | 180 |
| H40K/I41M/Y60gF/F97D/F99L/C122S/G151N/Q175L/Q192D | 181 |
| H40R/I41H/F97D/C122S/G151N/Q175M/Q192A/D217S/K224R | 182 |
| H40R/I41H/Y60gH/F97D/F99L/C122S/Q175M/Q192G/D2171/K224R | 183 |
| H40R/I41H/F97D/F99L/C122S/G151D/Q175M/Q192G/D217V | 184 |
| H40R/I41H/F97D/F99L/C122S/G151N/Q175M/Q192A/D217N/K224R | 185 |
| H40R/I41H/F97D/F99L/C122S/G151N/Q175L/Q192A/D217N/K224R | 186 |
| H40K/I41M/F97D/F99L/C122S/G151N/Q175M/Q192D/D217N/K224R | 187 |
| H40K/I41M/F97D/F99L/C122S/G151N/Q175L/Q192A/D217N/K224R | 188 |
| H40R/I41H/F97D/F99L/C122S/Q175M/Q192D/D217N/K224R | 189 |
| H40R/I41H/F97D/F99L/C122S/Q175M/D217N/K224R | 190 |
| H40K/I41M/F97D/F99L/C122S/Q175M/Q192D/D217N/K224R | 191 |
| H40K/I41M/F97D/F99L/C122S/G151N/Q175M/Q192A/D217N/K224R | 192 |
| H40K/I41M/F97D/F99L/C122S/Q175M/D217N/K224R | 193 |
| H40R/I41H/F97T/ins97aE/T98G/F99L/C122S/Q175L/Q192E | 194 |
| H40R/I41H/F97T/ins97aE/T98G/F99L/C122S/Q175L/Q192G | 195 |
| H40R/I41H/F97E/ins97aE/T98G/F99L/C122S/Q175L/Q192G | 196 |
| H40R/I41H/F97D/F99L/C122S/G151N/Q192H | 197 |
| H40R/I41H/F97D/F99L/C122S/G151N/L153R | 198 |
| H40R/I41H/F97D/C122S/G151N/L153R/V202M | 199 |
| H40R/I41H/F97D/F99L/C122S/G151N/Q192H/P232S | 200 |
| H40R/I41H/F97D/ins97aE/T98G/F99L/C122S/Q175L/Q192G | 201 |
| H40R/I41H/F97D/C122S/G151N/L153R | 202 |
| H40K/I41M/F99L/C122S/T150A/G151R/Q192G | 203 |
| H40R/I41H/F97D/C122S/G133D/G151N | 204 |
| I41R/F99L/C122S/Q192G | 205 |
| H40R/I41H/F99L/C122S/G151K/Q192G | 206 |
| I41R/ins97aE/F97T/T98G/F99L/C122S/G151E/Q175L/Q192E | 207 |
| K86R/K110R/C122S/K134R/K157R/K224R/K239R | 208 |
| H40R/I41H/K86R/F97D/K110R/C122S/K134R/G151N/K157R/K224R/K239R | 209 |
| K86R/F97T/ins97aE/T98G/F99L/K110R/C122S/K134R/K157R/Q175L/Q192E/K224R/K239R | 210 |
| H40R/I41H/F97D/F99L/C122S/Q175R/Q192G/D217H/K224S | 211 |
| H40R/I41H/F97D/F99L/C122S/Q192G/D2171/K224S | 212 |
| H40R/I41H/F97D/F99L/C122S/Q192G/D217K/K224A | 213 |
| H40R/I41H/F97D/F99L/C122S/Q175R/Q192G/D217E/K224R | 214 |
| H40R/I41H/F97D/C122S/Q175R/Q192G/D2171/K224Q | 215 |
| H40P/I41R/F99L/C122S/Q192G | 216 |
| H40P/I41R/F99L/C122S/G151K/Q192G | 217 |
| H40R/I41H/F99L/C122S/G151E/Q192G | 218 |
| I41R/ins97aE/F97T/T98G/F99L/C122S/G151D/Q175L/Q192E | 219 |
| I41R/ins97aE/F97T/T98G/F99L/C122S/G151D/Q175T/Q192E | 220 |
| I41R/ins97aE/F97T/T98G/F99L/C122S/G151D/Q175L/Q192D | 221 |
| I41R/ins97aE/F97T/T98G/F99L/C122S/G151E/Q175T/Q192D | 222 |
| H40P/I41R/ins97aE/F97T/T98G/F99L/C122S/Q175L/Q192E | 223 |
| H40P/I41R/ins97aE/F97T/T98G/F99L/C122S/G151D/Q175L/Q192E | 224 |
| I41R/ins97aE/F97T/T98G/F99L/C122S/G151N/Q175L/Q192E | 225 |
| I41R/ins97aE/F97T/T98G/F99L/C122S/G151N/Q175L/Q192D | 226 |
| I41R/ins97aE/F97T/T98G/F99L/C122S/G151N/Q175T/Q192E | 227 |
| I41R/ins97aE/F97T/T98G/F99L/C122S/G151N/Q175T/Q192D | 228 |
| I41R/ins97aE/F97T/T98G/F99L/C122S/Q175L/Q192E | 229 |
| H40P/I41R/F99L/C122S/G151E/Q192G | 230 |
| I41R/F97T/ins97aE/T98G/F99L/C122S/G151E/Q175T/Q192E | 231 |
| I41R/F97T/ins97aE/T98G/F99L/C122S/G151N/Q175S/Q192E | 232 |
| I41R/F97T/ins97aE/T98G/F99L/C122S/G151N/Q1751/Q192E | 233 |
| H40R/I41H/Y60gF/F97D/F99L/C122S/Q175K/Q192G/D217R/K224Q | 234 |
| H40R/I41H/F97D/F99L/C122S/Q175L/Q192G/D217Q/K224R | 235 |
| H40R/I41H/F97D/F99L/C122S/G151N/Q192N/D217L/K224R | 236 |
| H40R/I41H/F97D/F99L/C122S/G151N/Q192H/D217K/K224A | 237 |
| ins97aV/F97D/T98P/F99L/C122S/Q192G | 238 |

TABLE 12a-continued

Modified MTSP-1 Polypeptides

| Chymotrypsin numbering | SEQ ID NO |
|---|---|
| F97N/ins97aT/T98Y/F99N/C122S | 239 |
| F97M/ins97aD/T98D/F99L/C122S/Q192T | 240 |
| ins97aV/F97Q/T98P/F99L/C122S/Q175F/Q192D | 241 |
| ins97aD/F97T/T98S/F99L/C122S/Q192E/D217Y/K224R | 242 |
| ins97aN/F97H/T98D/F99L/C122S/Q192E/D217Q/K224S | 243 |
| F97Q/ins97aT/T98M/C122S/Q192E/D217R/K224L | 244 |
| ins97aD/F97Q/T98G/F99L/C122S/Q175L/Q192E/D217F/K224S | 245 |
| ins97aD/F97G/T98N/F99L/C122S/Q192E/D217Y/K224R | 246 |
| ins97aE/F97Y/T98S/F99L/C122S/Q192T/D217Q/K224R | 247 |
| ins97aG/F97N/T98D/F99L/C122S/Q192E/D217H/K224A | 248 |
| ins97aA/F97G/T98N/F99L/C122S/Q175M/Q192T/K224A | 249 |
| I41R/ins97aE/F97T/T98G/F99L/C122S/G151N/Q175S/Q192D | 250 |
| I41R/F97T/ins97aE/T98G/F99L/C122S/G151N/Q175I/Q192D | 251 |
| I41R/F97T/ins97aE/T98G/F99L/C122S/G151D/Q175I/Q192E | 252 |
| I41R/ins97aE/F97T/T98G/F99L/C122S/G151D/Q175I/Q192D | 253 |
| S90T/D96A/ins97aE/F97T/T98G/F99L/C122S/Q175L/Q192D | 254 |
| Y59F/ins97aE/F97T/T98G/F99L/C122S/Q175L/Q192E | 255 |
| ins97aE/F97T/T98G/F99L/C122S/Q175L/Q192E/Q209L | 256 |
| Y59F/D96V/ins97aE/F97T/T98G/F99L/C122S/Q175L/Q192E | 257 |
| D96V/ins97aE/F97T/T98G/F99L/C122S/Q175L/Q192D | 258 |
| I41R/ins97aE/F97T/T98G/F99L/C122S/G151S/Q175L/Q192E | 259 |
| E24K/ins97aE/F97T/T98G/F99L/C122S/A152S/Q175L/Q192D | 260 |
| ins97aE/F97T/T98G/F99L/C122S/L153Q/Q175L/Q192D | 261 |
| ins97aE/F97T/T98G/F99L/C122S/I136M/L155M/N170D/Q175L/Q192E | 262 |
| I41R/ins97aE/F97T/T98G/F99L/A112V/C122S/Q175L/Q192E | 263 |
| Y59F/F97T/ins97aE/T98G/F99L/C122S/Q175L/Q192D | 264 |
| Y59F/G60dS/R84H/ins97aE/F97T/T98G/F99L/C122S/Q175L/Q192E/V2121 | 265 |
| Y59F/ins97aE/F97T/T98G/F99L/C122S/L153Q/Q175L/Q192E | 266 |
| I41R/Y59F/ins97aE/F97T/T98G/F99L/C122S/Q175L/Q192D | 267 |
| I41R/Y59F/G60dS/R84H/ins97aE/F97T/T98G/F99L/C122S/Q175L/Q192E/V2121 | 268 |
| I41R/Y59F/ins97aE/F97T/T98G/F99L/C122S/L153Q/Q175L/Q192E | 269 |
| I41R/F97W/F99L/C122S/G151N/Q192G | 270 |
| F97D/ins97aV/T98P/F99L/C122S/G151N/Q192G | 271 |
| I41D/ins97aE/F97T/T98G/F99L/C122S/Q175L/Q192E | 272 |
| I41D/ins97aE/F97T/T98G/F99L/C122S/G151N/Q175L/Q192E | 273 |
| Q38E/H40R/I41H/F97D/F99L/C122S/Q192G | 274 |
| H40R/I41H/F97D/F99L/Q175R/Q192G/D217E/K224R | 275 |
| I41R/ins97aV/F97D/T98P/F99L/C122S/G151N/Q192G | 276 |
| ins97aV/F97D/T98P/F99L/C122S/Q175L/Q192E | 277 |
| I41R/ins97aV/F97D/T98P/F99L/C122S/G151N/Q175L/Q192E | 278 |
| Q38E/H40R/I41H/D60bE/F97D/F99L/C122S/Q192G | 279 |
| Q38E/H40R/I41H/D60bN/F97D/F99L/C122S/Q192G | 280 |
| Q38E/H40R/I41H/D60bK/F97D/F99L/C122S/Q175L/Q192G | 281 |
| Q38E/H40R/I41H/D60bN/F60eT/F97D/F99L/C122S/Q175L/Q192G | 282 |
| Q38R/I41S/D60bH/F60eV/F97T/ins97aE/T98G/F99L/C122S/Q175L/Q192E | 283 |
| Q38G/H40R/I41H/D60bK/F97D/F99L/C122S/Q175L/Q192G | 284 |
| I41D/ins97aE/F97T/T98G/F99L/C122S/G151N/Q175L/Q192E/Q209L | 285 |
| Q38G/H40R/I41H/D60bN/F97D/F99L/C122S/Q175L/Q192G | 286 |
| Q38R/I41S/D60bH/F60eV/ins97aE/F97T/T98G/F99L/C122S/G151N/Q175L/Q192E | 287 |
| H40R/I41H/F97D/ins97aV/T98P/F99L/C122S/Q175R/Q192G/D217E/K224R | 288 |
| Q38H/I41S/D60bA/F60eV/Y60gF/F97T/ins97aE/T98G/F99L/C122S/Q175L/Q192T | 289 |
| Q38E/I41S/D60bH/F60eI/F97T/ins97aE/T98G/F99L/C122S/Q175L/Q192V | 290 |
| Q38R/I41S/D60bH/F60e1/ins97aE/F97T/T98G/F99L/C122S/Q175L/Q192E | 291 |
| Q38E/I41S/D60bV/F60eK/F97T/ins97aE/T98G/F99L/C122S/Q175L/Q192I | 292 |
| Q38R/I41E/ins97aE/F97T/T98G/F99L/C122S/Q175L/Q192T | 293 |
| Q38H/I41A/D60bV/F60eR/Y60gW/ins97aE/F97T/T98G/F99L/C122S/Q175L/Q192D | 294 |
| Q38H/I41A/D60bA/F60eR/F97T/ins97aE/T98G/F99L/C122S/Q175L/Q192E | 295 |
| F97D/ins97aV/T98P/F99L/C122S/G151N/Q175L/Q192E | 296 |
| ins97aV/F97D/T98P/F99L/C122S/G151N/Q175L/Q192G | 297 |
| Q38G/H40R/I41H/D60bN/F60eT/F97D/F99L/C122S/Q175L/Q192G | 298 |
| Q38G/H40R/I41H/D60bK/F60eT/F97D/F99L/C122S/Q175L/Q192G | 299 |
| Q38E/H40R/I41H/D60bK/F60eT/F97D/F99L/C122S/Q175L/Q192G | 300 |
| Q38H/I41S/D60bA/F60eV/Y60gF/ins97aE/F97T/T98G/F99L/C122S/G151N/Q175L/Q192T | 301 |
| Q38E/I41S/D60bH/F60e1/ins97aE/F97T/T98G/F99L/C122S/G151N/Q175L/Q192V | 302 |
| Q38R/I41S/D60bH/F60e1/ins97aE/F97T/T98G/F99L/C122S/G151N/Q175L/Q192E | 303 |
| Q38E/I41S/D60bV/F60eK/ins97aE/F97T/T98G/F99L/C122S/G151N/Q175L/Q192I | 304 |
| Q38R/I41E/ins97aE/F97T/T98G/F99L/C122S/G151N/Q175L/Q192T | 305 |
| Q38H/I41A/D60bV/F60eR/Y60gW/ins97aE/F97T/T98G/F99L/C122S/G151N/Q175L/Q192D | 306 |
| Q38H/I41A/D60bA/F60eR/ins97aE/F97T/T98G/F99L/C122S/G151N/Q175L/Q192E | 307 |
| Q38H/I41S/D60bT/F60eS/ins97aV/F97D/T98P/F99L/C122S/G151H/Q175L/Q192E | 308 |
| Q38H/I41S/D60bV/F60eQ/Y60gF/ins97aE/F97T/T98G/F99L/C122S/Q175L/Q192I | 309 |
| Q38H/I41A/D60bV/F60e1/ins97aE/F97T/T98G/F99L/C122S/Q175L/Q192E | 310 |
| Q38H/I41A/D60bV/F60eT/Y60gW/ins97aE/F97T/T98G/F99L/C122S/Q175L/Q192E | 311 |

TABLE 12a-continued

Modified MTSP-1 Polypeptides

| Chymotrypsin numbering | SEQ ID NO |
|---|---|
| Q38H/I41A/F60eA/Y60gW/ins97aE/F97T/T98G/F99L/C122S/Q175L/Q192E | 312 |
| Q38H/I41A/D60bE/F60eH/Y60gW/ins97aE/F97T/T98G/F99L/C122S/Q175L/Q192D | 313 |
| Q38H/I41A/D60bT/F60eK/Y60gW/ins97aE/F97T/T98G/F99L/C122S/Q175L/Q192D | 314 |
| Q38H/I41A/D60bT/F60eH/Y60gW/ins97aE/F97T/T98G/F99L/C122S/Q175L/Q192D | 315 |
| Q38H/I41S/D60bS/F60eR/Y60gW/F97T/ins97aE/T98G/F99L/C122S/Q175L/Q192E | 316 |
| Q38H/I41S/D60bT/F60eS/F97D/ins97aV/T98P/F99L/C122S/G151H/Q175L/Q192D | 317 |
| Q38R/I41T/ins97aE/F97T/T98G/F99L/C122S/G151N/Q175L/Q192G | 318 |
| Q38S/I41S/F60eR/F97T/ins97aE/T98G/F99L/C122S/G151N/Q175L/Q192S | 319 |
| Q38H/I41T/D60bV/F60eQ/F97T/ins97aE/T98G/F99L/C122S/Q175L/Q192G | 320 |
| Q38G/H40R/I41H/D60bH/F60eK/F97T/ins97aE/T98G/F99L/C122S/Q175L/V183A/Q192G | 321 |
| Q38H/I41A/F97T/ins97aE/T98G/F99L/C122S/Q175L/Q192G | 322 |
| Q38L/I41T/D60bR/F60eL/Y60gM/F97T/ins97aE/T98G/F99L/C122S/G151N/Q175L/Q192G | 323 |
| Q38F/I41S/D60bF/F60eR/Y60gF/F97T/ins97aE/T98G/F99L/C122S/G151N/Q175L/Q192V | 324 |
| Q38V/I41S/D60bT/F60eT/F97D/ins97aV/T98P/F99L/C122S/G151N/Q175H/Q192S | 325 |
| Q38W/I41A/ins97aV/F97D/T98P/F99L/C122S/G151T/Q175S/Q192D | 326 |
| Q38T/I41S/D60bV/F60eR/ins97aV/F97D/T98P/F99L/C122S/G151N/Q175R/Q192V | 327 |
| Q38H/I41S/D60bT/F60eS/ins97aV/F97D/T98P/F99L/C122S/G151H/Q175A/Q192D | 328 |
| Q38H/I41S/D60bT/F60eT/F97D/ins97aV/T98P/F99L/C122S/G151N/Q175L/Q192V | 329 |
| Q38Y/I41A/D60bL/F60eQ/ins97aV/F97D/T98P/F99L/C122S/G151N/Q175M/Q192A | 330 |
| Q38L/I41T/D60bA/F60eL/ins97aV/F97D/T98P/F99L/C122S/G151H/Q175M/Q192T | 331 |
| Q38R/I41S/D60bY/F60eD/ins97aV/F97D/T98P/F99L/C122S/G151N/Q175M/Q192A | 332 |
| Q38W/I41S/D60bG/F60e1/F97D/ins97aV/T98P/F99L/C122S/G151N/Q175A/Q192D | 333 |
| Q38T/I41S/D60bG/F60eM/ins97aV/F97D/T98P/F99L/C122S/G151N/Q175S/Q192S | 334 |
| I41T/D60bW/F60eH/F97D/ins97aV/T98P/F99L/C122S/G151N/Q175L/Q192G | 335 |
| Q38D/I41S/D60bT/F60eR/ins97aV/F97D/T98P/F99L/C122S/G151K/Q175S/Q192V | 336 |
| Q38H/I41S/D60bF/F60eV/F97D/ins97aV/T98P/F99L/C122S/G151N/Q175L/Q192A | 337 |
| Q38L/I41A/D60bH/F60eT/ins97aV/F97D/T98P/F99L/C122S/G151Q/Q175A/Q192G | 338 |
| Q38H/I41A/D60bE/F60eH/Y60gW/F97T/ins97aE/T98G/F99L/C122S/G151N/Q175L/Q192D | 339 |
| Q38H/I41A/D60bV/F60e1/Y60gW/F97T/ins97aE/T98G/F99L/C122S/G151N/Q175L/Q192D | 340 |
| Q38E/I41S/D60bV/F60eK/Y60gW/F97T/ins97aE/T98G/F99L/C122S/G151N/Q175L/Q192D | 341 |
| Q38H/I41S/D60bT/F60eS/Y60gW/ins97aV/F97D/T98P/F99L/C122S/G151H/Q175L/Q192D | 342 |
| Q38H/I41S/D60bT/F60eS/Y60gW/F97D/ins97aV/T98P/F99L/C122S/G151H/Q175A/Q192D | 343 |
| Q38H/I41A/D60bV/F60eR/ins97aE/F97T/T98G/F99L/C122S/G151N/Q175L/Q192D | 344 |
| Q38H/I41A/D60bT/F60eH/Y60gW/F97T/ins97aE/T98G/F99L/C122S/G151N/Q175L/Q192D | 345 |
| D60bY/F97T/ins97aE/T98G/F99L/C122S/Q175L/Q192G | 346 |
| I41T/D60bY/F97T/ins97aE/T98G/F99L/C122S/Q175L/Q192G | 347 |
| Q38E/I41S/D60bT/F60eR/F97T/ins97aE/T98G/F99L/C122S/Q175L/Q192V | 348 |
| Q38H/I41A/D60bK/F60eK/Y60gW/ins97aE/F97T/T98G/F99L/C122S/Q175L/Q192D | 349 |
| Q38H/I41S/D60bA/F60eV/ins97aE/F97T/T98G/F99L/C122S/Q175L/Q192E/Q209L | 350 |
| Q38H/I41A/D60bT/F60eR/F97T/ins97aE/T98G/F99L/C122S/Q175L/Q192V | 351 |
| Q38K/I41S/F97T/ins97aE/T98G/F99L/C122S/Q175L/Q192V | 352 |
| Q38F/I41A/D60bT/F60eG/Y60gW/ins97aE/F97T/T98G/F99L/C122S/Q175L/Q192E | 353 |
| Q38H/I41A/F60eH/Y60gW/ins97aE/F97T/T98G/F99L/C122S/Q175L/Q192A | 354 |
| Q38H/I41A/D60bT/F60eK/Y60gW/F97T/ins97aE/T98G/F99L/C122S/Q175L/Q192A | 355 |
| Q38H/I41A/D60bV/F60eA/Y60gW/F97T/ins97aE/T98G/F99L/C122S/Q175L/Q192V | 356 |
| Q38E/I41V/D60bF/F60eK/Y60gF/F97T/ins97aE/T98G/F99L/C122S/Q175L/Q192G | 357 |
| Q38H/H40P/I41A/F60eQ/Y60gW/F97T/ins97aE/T98G/F99L/C122S/Q175L/Q192D | 358 |
| Q38R/I41V/D60bV/F60eV/Y60gF/ins97aE/F97T/T98G/F99L/C122S/Q175L/Q192G | 359 |
| Q38L/H40P/I41T/D60bV/F60eH/Y60gL/ins97aE/F97T/T98G/F99L/C122S/Q175L/Q192A | 360 |
| Q38H/I41A/D60bV/F60eH/ins97aE/F97T/T98G/F99L/C122S/Q175L/Q192D | 361 |
| Q38H/I41S/D60bA/F60eV/ins97aE/F97T/T98G/F99L/C122S/Q175L/Q192V | 362 |
| Q38R/I41T/D60bH/ins97aE/F97T/T98G/F99L/C122S/Q175L/Q192G | 363 |
| Q38H/I41S/D60bT/F60eR/ins97aE/F97T/T98G/F99L/C122S/Q175L/Q192E | 364 |
| Q38K/I41T/ins97aE/F97T/T98G/F99L/C122S/Q175L/Q192A | 365 |
| Q38H/I41A/D60bT/F60eK/ins97aE/F97T/T98G/F99L/C122S/Q175L/Q192E | 366 |
| Q38L/I41T/D60bV/F60eH/Y60gL/ins97aE/F97T/T98G/F99L/C122S/Q175L/Q192S | 367 |
| ins97aA/F97G/T98L/C122S/Q175M/Q192A/D217I/K224R | 368 |
| Q38H/I41A/D60bY/F60eT/ins97aE/F97T/T98G/F99L/C122S/Q175L/Q192D | 369 |
| ins97aY/F97H/F99L/C122S/Q175M/Q192A/D217V | 370 |
| ins97aL/F97Q/T98G/F99L/C122S/Q175M/Q192S/D217I | 371 |
| ins97aY/F97G/T98V/C122S/Q175M/Q192S/D217V | 372 |
| Q38Y/I41S/D60bR/F60eE/Y60gF/ins97aE/F97T/T98G/F99L/C122S/Q175L/Q192V | 373 |
| Q38H/I41S/D60bT/F60eS/ins97aV/F97D/T98P/F99L/C122S/G151H/Q175L/Q192V | 374 |
| Q38H/I41S/D60bT/F60eS/Y60gW/ins97aV/F97D/T98P/F99L/C122S/G151H/Q175L/Q192V | 375 |

TABLE 12a-continued

| Modified MTSP-1 Polypeptides | |
|---|---|
| Chymotrypsin numbering | SEQ ID NO |
| Q38H/I41S/D60bT/F60eS/Y60gW/ins97aV/F97D/T98P/F99L/C122S/G151N/Q175A/ Q192D | 376 |
| Q38H/I41S/D60bT/F60eS/Y60gW/ins97aV/F97D/T98P/F99L/C122S/G151N/Q175L/ Q192E | 377 |
| Q38H/I41A/D60bE/F60eH/Y60gW/ins97aE/F97T/T98G/F99L/C122S/G151H/Q175L/ Q192D | 378 |
| Q38H/I41A/D60bT/F60eK/Y60gW/ins97aE/F97T/T98G/F99L/C122S/G151H/Q175L/ Q192D | 379 |
| Q38H/I41A/D60bV/F60e1/Y60gW/ins97aE/F97T/T98G/F99L/C122S/G151H/Q175L/ Q192D | 380 |
| Q38E/I41S/D60bV/F60eK/Y60gW/ins97aE/F97T/T98G/F99L/C122S/G151H/Q175L/ Q192D | 381 |
| Q38H/I41S/L52M/D60bG/ins97aV/F97D/T98P/F99L/M117K/C122S/1136L/Q192G/ D217A | 382 |
| Q38E/I41A/D60bH/ins97aV/F97D/T98P/F99L/C122S/Q192G/Q209L/D217H | 383 |
| I41S/D60bT/F93L/ins97aV/F97D/T98P/F99L/C122S/Q192G/D217H | 384 |
| I41T/D60bH/ins97aV/F97D/T98P/F99L/C122S/Q192G/D2171 | 385 |
| Q38H/I41S/D60bS/ins97aV/F97D/T98P/F99L/M117L/C122S/I136T/Q192G/D2171 | 386 |
| Q38R/I41T/D60bT/ins97aV/F97D/T98P/F99L/C122S/1136V/Q192G/D217N/L233Q | 387 |
| Q38H/I41A/D60bW/ins97aV/F97D/T98P/F99L/C122S/1136M/Q192G/D217N | 388 |
| Q38H/I41S/P49Q/D60bS/F93L/ins97aV/F97D/T98P/F99L/C122S/Q192G/D217Q | 389 |
| Q38H/I41S/D60bT/ins97aV/F97D/T98P/F99L/C122S/1136V/Q192G/D217S | 390 |
| Q38H/I41S/D60bS/F93L/D96Y/ins97aV/F97D/T98P/F99L/C122S/1136F/Q192G/ D217V | 391 |
| Q38H/I41T/D60bH/ins97aV/F97D/T98P/F99L/C122S/1136F/L153P/Q192G/D217Y | 392 |
| Q38H/I41S/D60bT/F93L/ins97aV/F97D/T98P/F99L/S115N/C122S/Q192V/F208L/ D217Q | 393 |
| Q38K/I41T/D60bY/ins97aV/F97D/T98P/F99L/C122S/1136T/Q192G/F208V/D217R | 394 |
| Q38H/I41S/D60bS/ins97aV/F97D/T98P/F99L/C122S/1136V/Q192G/D217V | 395 |
| Q38H/I41S/D60bG/ins97aV/F97D/T98P/F99L/M117T/C122S/N164D/Q192G/D217E | 396 |
| Q38K/I41S/D60bV/ins97aV/F97D/T98P/F99L/M117T/C122S/Q145E/Q175L/Q192G | 397 |
| Q38H/I41S/D60bT/F60eT/Y60gW/ins97aV/F97D/T98P/F99L/C122S/G151H/Q175L/ Q192V | 398 |
| Q38H/I41S/D60bT/F60eS/Y60gW/ins97aV/F97D/T98P/F99L/C122S/G151N/Q175L/ Q192D | 399 |
| Q38H/I41A/D60bV/F60eR/Y60gW/ins97aE/F97T/T98G/F99L/C122S/G151H/Q175L/ Q192D | 400 |
| Q38H/I41S/L52M/D60bH/D96V/ins97aV/F97D/T98P/F99L/C122S/T150A/Q192G/ Q209L/D217T | 401 |
| I41S/D60bS/D96V/ins97aV/F97D/T98P/F99L/C122S/Q192G/F208L/D217N | 402 |
| Q38H/I41S/D60bT/S90T/F97D/ins97aV/T98P/F99L/C122S/S127N/1136F/Q192G/D217Q | 403 |
| Q38H/I41S/D60bT/F93S/ins97aV/F97D/T98P/F99L/C122S/1136L/Q192G/D217A | 404 |
| I41S/D60bH/ins97aV/F97D/T98P/F99L/C122S/1136V/Q192G/D217N | 405 |
| L33M/Q38H/I41A/D60bA/ins97aV/F97D/T98P/F99L/C122S/Q192G/D217N | 406 |
| Q38H/I41S/D60bY/D96Y/ins97aV/F97D/T98P/F99L/L106M/C122S/1136M/Q192G/ Q209L/D217T | 407 |
| Q38H/I41A/D60bV/F60eR/Y60gW/D961/ins97aN/F97Y/T98G/F99L/C122S/G151N/ Q175L/Q192D | 408 |
| Q38H/I41S/D60bT/F60eS/Y60gW/D96K/ins97aA/F97D/T98P/F99L/C122S/G151H/ Q175L/Q192D | 409 |
| Q38H/I41T/D60bV/F60eR/Y60gW/D961/ins97aN/F97Y/T98G/F99L/C122S/G151N/ Q175L/Q192D | 410 |
| Q38H/I41A/D60bV/F60eR/Y60gW/D96Y/ins97a1/F97E/T98N/F99M/C122S/G151N/ Q175L/Q192V | 411 |
| Q38H/I41A/D60bV/F60eR/Y60gW/D96S/ins97aR/F97A/T98S/F99L/C122S/G151N/ Q175L/Q192T | 412 |
| Q38H/I41A/D60bV/F60eR/Y60gW/D96P/ins97aN/F97W/T98G/F99L/C122S/G151N/ Q175L/Q192E | 413 |
| Q38H/I41S/D60bT/F60eS/Y60gW/F97D/F99L/C122S/G151H/Q175L/Q192D | 414 |
| Q38H/I41S/D60bT/F60eS/Y60gW/D96Y/ins97aV/F97E/T98G/F99L/C122S/G151H/ Q175L/Q192D | 415 |
| Q38H/I41S/D60bA/Y60gG/ins97aV/F97D/T98P/F99L/C122S/H143T/G151N/Q175L/ Q192A | 416 |
| Q38H/I41S/D60bT/F60eH/Y60gF/ins97aV/F97D/T98P/F99L/C122S/H143R/G151N/ Q175L/Q192S | 417 |
| Q38H/I41S/D60bS/F60eQ/Y60gF/ins97aV/F97D/T98P/F99L/C122S/H143R/G151N/ Q175L/Q192T | 418 |
| Q38H/I41S/D60bF/F60eT/ins97aV/F97D/T98P/F99L/C122S/H143Q/G151N/Q175L/ Q192G | 419 |
| Q38H/I41S/D60bF/F60eQ/Y60gF/ins97aV/F97D/T98P/F99L/C122S/H143A/G151N/ Q175L/Q192A | 420 |
| Q38H/I41S/D60bT/F60eT/ins97aV/F97D/T98P/F99L/C122S/H143Q/G151Q/Q175L/ Q192G | 421 |
| Q38H/I41S/D60bQ/F60eQ/F97D/ins97aV/T98P/F99L/C122S/H143Q/G151Q/Q175L/ Q192G | 422 |

TABLE 12a-continued

Modified MTSP-1 Polypeptides

| Chymotrypsin numbering | SEQ ID NO |
|---|---|
| Q38H/I41S/D60bS/F60eQ/ins97aV/F97D/T98P/F99L/C122S/H143A/G151N/Q175L/Q192G | 423 |
| Q38H/I41A/D60bV/F60eR/Y60gW/D96Q/F97E/ins97aD/T98S/F99L/C122S/G151N/Q175L/Q192R | 424 |
| Q38H/I41S/D60bT/F60eS/Y60gW/D96F/F97D/ins97aE/T98S/F99L/C122S/G151H/Q175L/Q192A | 425 |
| Q38H/I41S/D60bT/F60eS/Y60gW/D96L/ins97aG/F97D/T98N/F99L/C122S/G151H/Q175L/Q192E | 426 |
| Q38H/I41S/D60bT/F60eS/Y60gW/D96K/ins97aV/F97G/T98P/F99L/C122S/G151H/Q175L/Q192D | 427 |
| Q38H/I41A/D60bV/F60eR/Y60gW/D96I/ins97aN/F97Y/T98G/F99L/C122S/G151H/Q175L/Q192D | 428 |
| Q38H/I41A/D60bV/F60eR/Y60gW/D96I/F97N/T98G/F99L/C122S/G151H/Q175L/Q192D | 429 |
| Q38H/I41S/D60bT/F60eS/Y60gW/F97D/F99L/C122S/G151N/Q175L/Q192D | 430 |
| Q38H/I41S/D60bT/F60eS/Y60gW/D96Y/ins97aV/F97E/T98G/F99L/C122S/G151N/Q175L/Q192D | 431 |
| Q38H/I41A/D60bV/F60eR/Y60gW/D96P/ins97aN/F97W/T98G/F99L/C122S/G151H/Q175L/Q192E | 432 |
| Q38H/I41A/D60bV/F60eR/Y60gW/D96P/ins97aN/F97W/T98G/F99L/C122S/G151N/Q175L/Q192D | 433 |
| Q38H/I41A/D60bV/F60eR/Y60gW/D96P/ins97aN/F97W/T98G/F99L/C122S/G151H/Q175L/Q192D | 434 |
| Q38H/I41A/D60bV/F60eR/Y60gW/F97D/F99L/C122S/G151H/Q175L/Q192D | 435 |
| Q38H/I41S/D60bT/F60eS/Y60gW/D96I/F97N/T98G/F99L/C122S/G151N/Q175L/Q192D | 436 |
| Q38H/I41A/D60bV/F60eR/Y60gW/F97D/F99L/C122S/G151N/Q175L/Q192D | 437 |
| I41S/D60bT/F60eS/Y60gW/ins97aV/F97D/T98P/F99L/C122S/G151H/Q175L/Q192E | 438 |
| Q38H/D60bT/F60eS/Y60gW/ins97aV/F97D/T98P/F99L/C122S/G151H/Q175L/Q192E | 439 |
| Q38H/I41S/F60eS/Y60gW/ins97aV/F97D/T98P/F99L/C122S/G151H/Q175L/Q192E | 440 |
| Q38H/I41S/D60bT/F60eS/Y60gW/ins97aV/T98P/F99L/C122S/G151H/Q175L/Q192E | 441 |
| Q38H/I41S/D60bT/F60eS/Y60gW/F97D/T98P/F99L/C122S/G151H/Q175L/Q192E | 442 |
| Q38H/I41S/D60bT/F60eS/Y60gW/ins97aV/F97D/F99L/C122S/G151H/Q175L/Q192E | 443 |
| Q38H/I41S/D60bT/F60eS/Y60gW/ins97aV/F97D/T98P/C122S/G151H/Q175L/Q192E | 444 |
| Q38H/I41S/D60bT/F60eS/Y60gW/ins97aV/F97D/T98P/F99L/C122S/Q175L/Q192E | 445 |
| Q38H/I41S/D60bT/F60eS/Y60gW/F97D/ins97aV/T98P/F99L/C122S/G151H/Q192E | 446 |
| Q38H/I41S/D60bT/F60eS/Y60gW/ins97aV/F97D/T98P/F99L/C122S/G151H/Q175L | 447 |
| Q38H/I41S/D60bT/F60eS/Y60gW/F97D/ins97aA/T98P/F99L/C122S/G151H/Q175L/Q192E | 448 |
| Q38H/I41S/D60bT/Y60gW/ins97aV/F97D/T98P/F99L/C122S/G151H/Q175L/Q192E | 449 |
| Q38H/I41S/D60bT/F60eG/Y60gW/D96V/F97N/T98G/F99L/C122S/G151N/Q175L/Q192D | 450 |
| Q38K/I41G/F60eG/Y60gW/D96P/F97N/T98G/F99L/C122S/G151N/Q175L/Q192D | 451 |
| Q38Y/I41E/D60bS/F60eV/Y60gF/D96W/F97N/T98G/F99L/C122S/G151N/Q175L/Q192D | 452 |
| Q38H/I41S/D60bT/F60eG/D96Y/F97N/T98G/F99L/C122S/G151N/Q175L/Q192D | 453 |
| Q38V/I41G/F60eG/Y60gW/D96P/F97N/T98G/F99L/C122S/G151N/Q175L/Q192D | 454 |
| Q38Y/I41A/D60bT/F60eG/Y60gW/D96V/F97N/T98G/F99L/C122S/G151H/Q175L/Q192D | 455 |
| Q38H/I41S/D60bT/F60eG/D96P/F97N/T98G/F99L/C122S/G151Q/Q175L/Q192D | 456 |
| Q38K/I41G/D60bT/F60eG/Y60gW/D96P/F97N/T98G/F99L/C122S/G151N/Q175L/Q192D | 457 |
| Q38K/I41G/D60bT/F60eG/Y60gW/D96L/F97N/T98G/F99L/C122S/G151N/Q175L/Q192D | 458 |
| Q38E/I41S/D60bV/F60eK/Y60gW/D96P/F97N/T98G/F99L/C122S/G151N/Q175L/Q192D | 459 |
| Q38E/I41S/D60bW/F60eG/D96M/F97N/T98G/F99L/C122S/G151N/Q175L/Q192D | 460 |
| Q38M/I41S/F60eH/Y60gW/D96Y/F97N/T98G/F99L/C122S/G151N/Q175L/Q192D | 461 |
| Q38H/I41A/D60bV/F60eR/Y60gW/D96F/F97D/ins97aE/T98G/F99M/C122S/G151N/Q175L/Q192R | 462 |
| Q38H/I41A/D60bV/F60eR/Y60gW/D96F/F97E/ins97aT/T98G/F99M/C122S/G151N/Q175L/Q192G | 463 |
| Q38H/I41A/D60bV/F60eR/Y60gW/D96F/F97E/ins97aS/T98G/F99M/C122S/G151N/Q175L/Q192G | 464 |
| Q38H/I41A/D60bV/F60eR/Y60gW/D96W/F97D/ins97aD/T98G/F99L/C122S/G151N/Q175L/Q192G | 465 |
| Q38H/I41A/D60bV/F60eR/Y60gW/D96F/F97Y/ins97aE/T98G/F99M/C122S/G151N/Q175L/Q192R | 466 |
| Q38H/I41A/D60bV/F60eR/Y60gW/D96W/F97D/ins97aT/T98G/F99L/C122S/G151N/Q175L/Q192G | 467 |
| Q38H/I41S/D60bT/F60eK/Y60gF/D96M/F97N/T98G/F99L/C122S/G151N/Q175L/Q192D | 468 |
| Q38H/I41A/D60bV/F60eR/Y60gW/D96F/F97S/ins97aH/T98G/F99L/C122S/G151N/Q175L/Q192G | 469 |

TABLE 12a-continued

Modified MTSP-1 Polypeptides

| Chymotrypsin numbering | SEQ ID NO |
|---|---|
| Q38H/I41A/D60bV/F60eR/Y60gW/D96F/F97Y/ins97aN/T98G/F99M/C122S/G151N/Q175L/Q192G | 470 |
| Q38H/I41S/D60bT/F60eS/Y60gW/D96F/F97S/ins97aD/T98G/F99L/C122S/G151H/Q175L/Q192D | 471 |
| Q38H/I41S/D60bT/F60eS/Y60gW/D96F/F97Y/ins97aD/T98G/F99L/C122S/G151H/Q175L/Q192D | 472 |
| Q38H/I41S/D60bT/F60eS/Y60gW/D96Y/F97N/ins97aE/T98S/F99L/C122S/G151H/Q175L/Q192D | 473 |
| Q38H/I41S/D60bT/F60eS/Y60gW/D96Y/F97R/ins97aD/T98G/F99L/C122S/G151H/Q175L/Q192D | 474 |
| Q38H/I41A/D60bT/F60eK/Y60gF/F97T/ins97aE/T98G/F99L/C122S/H143R/G151N/Q175L/Q192V | 475 |
| Q38Y/I41S/D60bV/F60eR/Y60gF/D96M/F97N/T98G/F99L/C122S/G151N/Q175L/Q192D | 476 |
| Q38E/I41S/D60bV/F60eK/Y60gW/D96M/F97N/T98G/F99L/C122S/G151N/Q175L/Q192D | 477 |
| Q38Y/I41S/D60bT/F60eR/Y60gW/D96M/F97N/T98G/F99L/C122S/G151N/Q175L/Q192D | 478 |
| Q38H/I41S/F60eT/Y60gW/D96M/F97N/T98G/F99L/C122S/G151N/Q175L/Q192D | 479 |
| Q38H/I41S/D60bT/F60eK/D96V/F97N/T98G/F99L/C122S/G151N/Q175L/Q192D | 480 |
| I41S/D60bT/F60eR/Y60gW/D96M/F97N/T98G/F99L/C122S/G151N/Q175L/Q192D | 481 |
| Q38Y/D60bT/F60eR/Y60gW/D96M/F97N/T98G/F99L/C122S/G151N/Q175L/Q192D | 482 |
| Q38Y/I41S/F60eR/Y60gW/D96M/F97N/T98G/F99L/C122S/G151N/Q175L/Q192D | 483 |
| Q38Y/I41S/D60bT/Y60gW/D96M/F97N/T98G/F99L/C122S/G151N/Q175L/Q192D | 484 |
| Q38Y/I41S/D60bT/F60eR/D96M/F97N/T98G/F99L/C122S/G151N/Q175L/Q192D | 485 |
| Q38Y/I41S/D60bT/F60eR/Y60gW/F97N/T98G/F99L/C122S/G151N/Q175L/Q192D | 486 |
| Q38Y/I41S/D60bT/F60eR/Y60gW/D96M/T98G/F99L/C122S/G151N/Q175L/Q192D | 487 |
| Q38Y/I41S/D60bT/F60eR/Y60gW/D96M/F97N/F99L/C122S/G151N/Q175L/Q192D | 488 |
| Q38Y/I41S/D60bT/F60eR/Y60gW/D96M/F97N/T98G/C122S/G151N/Q175L/Q192D | 489 |
| Q38Y/I41S/D60bT/F60eR/Y60gW/D96M/F97N/T98G/F99L/C122S/G151N/Q192D | 490 |
| Q38Y/I41S/D60bT/F60eR/Y60gW/D96M/F97N/T98G/F99L/C122S/G151N/Q175L | 491 |
| Q38Y/I41S/D60bT/F60eR/Y60gW/D96M/F97N/T98G/F99L/C122S/Q175L/Q192D | 492 |
| Q38H/I41S/D60bT/F60eS/Y60gW/D96K/F97G/ins97aV/T98P/F99L/M117K/C122S/G151H/Q175L/Q192D | 493 |
| L36Q/Q38H/I41S/D60bT/F60eS/Y60gW/D96K/F97G/ins97aV/T98P/F99L/C122S/G151H/Q175L/Q192D | 494 |
| Q38H/I41S/D60bT/F60eS/Y60gW/D96K/F97G/ins97aV/T98P/F99L/C122S/T150S/G151H/Q175L/Q192D/Q209L | 495 |
| Q38H/I41S/D60bT/F60eS/Y60gW/D96K/F97G/ins97aA/T98P/F99L/C122S/G151H/Q175L/Q192D | 496 |
| I41G/F97A/F99L/C122S/G151H/Q175L/Q192G/D217L | 497 |
| I41G/F97S/F99L/C122S/G151N/Q175I/Q192T/D217T | 498 |
| I41R/F97A/F99L/C122S/G151N/Q175R/Q192G/D217Q | 499 |
| I41S/F97E/F99L/C122S/G151N/Q175G/Q192R/D217A | 500 |
| I41G/F97S/F99L/C122S/G151T/Q175R/Q192A/D217Y | 501 |
| I41G/F97L/F99L/C122S/G151N/Q175A/Q192V/D217R | 502 |
| I41G/F97T/F99M/C122S/G151D/Q175T/Q192T/D217V | 503 |
| I41G/F97L/F99L/C122S/G151T/Q175M/Q192D/D217M | 504 |
| F97S/F99L/C122S/G151N/Q175I/Q192T/D217T | 505 |
| I41G/F99L/C122S/G151N/Q175I/Q192T/D217T | 506 |
| I41G/F97S/C122S/G151N/Q175I/Q192T/D217T | 507 |
| I41G/F97S/F99L/C122S/Q175I/Q192T/D217T | 508 |
| I41G/F97S/F99L/C122S/G151N/Q192T/D217T | 509 |
| I41G/F97S/F99L/C122S/G151N/Q175I/D217T | 510 |
| I41G/F97S/F99L/C122S/G151N/Q175I/Q192T | 511 |
| F97R/ins97aT/T98V/C122S/Q175M/Q192T/D217S | 512 |
| F97V/ins97aH/T98R/F99L/C122S/Q175R/Q192G/D217S | 513 |
| F97Q/F99L/C122S/Q175N/Q192V/D217G | 514 |
| F97L/ins97aM/T98N/F99L/C122S/Q175T/Q192T/D217S | 515 |
| F97S/ins97aN/T98G/F99M/C122S/Q175T/Q192T/D217S | 516 |
| I41T/F97H/F99L/C122S/G151N/Q175H/Q192V/D217L | 517 |
| I41R/F97T/F99L/C122S/G151N/Q175T/Q192T/D217I | 518 |
| I41E/F97V/F99L/C122S/G151N/Q175L/Q192S/D217H | 519 |
| I41D/F97R/F99L/C122S/G151Q/Q175R/Q192V/D217L | 520 |
| I41E/F97R/F99L/C122S/G151Q/Q175G/Q192T/D217V | 521 |
| I41D/F97T/F99L/C122S/G151N/Q175S/Q192T/D217A | 522 |
| I41E/F97A/F99M/C122S/G151N/Q175R/Q192S/D217E | 523 |
| I41G/F99L/C122S/Q175I/Q192T/D217T | 524 |
| I41G/F99L/C122S/G151N/Q192T/D217T | 525 |
| I41G/F99L/C122S/G151N/Q175I/Q192T | 526 |
| F97V/F99L/C122S/G151N/Q175L/Q192S/D217H | 527 |
| I41E/F99L/C122S/G151N/Q175L/Q192S/D217H | 528 |
| I41E/F97V/F99L/C122S/Q175L/Q192S/D217H | 529 |
| I41E/F97V/F99L/C122S/G151N/Q192S/D217H | 530 |
| I41E/F97V/F99L/C122S/G151N/Q175L/D217H | 531 |

TABLE 12a-continued

Modified MTSP-1 Polypeptides

| Chymotrypsin numbering | SEQ ID NO |
|---|---|
| I41E/F97V/F99L/C122S/G151N/Q175L/Q192S | 532 |
| F97R/F99L/C122S/G151Q/Q175R/Q192V/D217L | 533 |
| I41D/F99L/C122S/G151Q/Q175R/Q192V/D217L | 534 |
| I41D/F97R/F99L/C122S/Q175R/Q192V/D217L | 535 |
| I41D/F97R/F99L/C122S/G151Q/Q192V/D217L | 536 |
| I41D/F97R/F99L/C122S/G151Q/Q175R/D217L | 537 |
| I41D/F97R/F99L/C122S/G151Q/Q175R/Q192V | 538 |
| I41E/F97R/F99L/C122S/G151Q/Q175G/Q192T | 539 |
| I41D/F99L/C122S/G151N/Q175S/Q192T/D217A | 540 |
| I41D/F97T/F99L/C122S/Q175S/Q192T/D217A | 541 |
| I41D/F97T/F99L/C122S/G151N/Q192T/D217A | 542 |
| I41D/F97T/F99L/C122S/G151N/Q175S/D217A | 543 |
| I41D/F97T/F99L/C122S/G151N/Q175S/Q192T | 544 |
| F97T/F99L/C122S/G151N/Q175S/Q192T/D217A | 545 |
| I41S/F97Q/F99L/C122S/Q175W/Q192V/D217R | 546 |
| I41G/F97L/F99L/C122S/G151N/Q192V/D217L | 547 |
| I41G/F97A/F99L/C122S/G151N/Q175M/Q192S | 548 |
| I41G/F97V/F99L/C122S/G151N/Q192T/D217V | 549 |
| I41D/F97R/F99L/C122S/Q175L/Q192T/D217I | 550 |
| I41E/F97S/F99L/C122S/Q175L/Q192V/D217A | 551 |
| F97L/F99L/C122S/Q175K/Q192V/D217M | 552 |
| F97E/F99L/C122S/G151A/Q192V | 553 |
| F97E/F99L/C122S/Q175H/Q192V/D217P | 554 |
| F97R/ins97a1/T98P/C122S/Q175M/Q192V/D217I | 555 |
| I41D/F99L/C122S/G151N/Q192T/D217A | 556 |
| I41D/F99L/C122S/G151N/Q175S/Q192T | 557 |
| I41D/F97T/F99L/C122S/G151N/Q192T | 558 |
| I41D/F99L/C122S/G151N/Q192T | 559 |
| I41D/F99L/C122S/Q175S/Q192T | 560 |
| I41D/F99L/C122S/Q192T | 561 |
| Q38R/I41G/Y6OgG/F99M/C122S/G151N/Q192R | 562 |
| Q38K/I41G/Y6OgG/F99L/C122S/G151N/Q192H | 563 |
| Q38L/I41R/Y60gF/F99L/C122S/G151N/Q192A | 564 |
| Q38K/I41D/Y60gG/F99L/C122S/G151N | 565 |
| Q38R/I41R/Y60gF/F99L/C122S/G151N/Q192G | 566 |
| Q38S/I41S/Y60gW/F99L/C122S/G151D/Q192T | 567 |
| Q38K/I41G/Y60gW/F99L/C122S/G151N/Q192A | 568 |
| Q38H/I41S/Y60gW/C122S/G151H/Q192A | 569 |
| Q38K/I41S/Y60gW/F99L/C122S/G151N/Q192G | 570 |
| Q38F/I41S/Y60gA/C122S/G151N/Q192R | 571 |
| Q38R/I41S/Y60gW/F99L/C122S/G151N/Q192E | 572 |
| Q38K/I41R/Y6OgG/F99L/C122S/G151N/Q192G | 573 |
| Q38R/I41R/F99L/C122S/G151N/Q192G | 574 |
| Q38R/I41R/Y60gL/F99L/C122S/G151N/Q192G | 575 |
| I41E/C122S/G151N/Q175L/Q192A | 576 |
| I41S/F99M/C122S/G151N/Q175L/Q192G | 577 |
| I41E/F99L/C122S/G151N/Q175L/Q192A | 578 |
| I41S/F99L/C122S/G151H/Q175L/Q192V | 579 |
| I41G/F99L/C122S/G151N/Q192A | 580 |
| I41S/F99M/C122S/G151N/Q175G/Q192R | 581 |
| I41E/F99L/C122S/G151N/Q175R/Q192H | 582 |
| I41S/F99M/C122S/G151N/Q175E/Q192R | 583 |
| I41E/F99L/C122S/G151N/Q192V | 584 |
| I41E/F99L/C122S/G151N/Q192S | 585 |
| I41S/F99L/C122S/G151N/Q175P/Q192V | 586 |
| I41E/F99L/C122S/G151N/Q175G/Q192T | 587 |
| I41S/C122S/G151N/Q175R/Q192R | 588 |
| I41S/F99M/C122S/G151N/Q175P/Q192S | 589 |
| I41S/C122S/G151N/Q175D/Q192R | 590 |
| I41E/F99L/C122S/G151N/Q175R/Q192T | 591 |
| I41G/F99L/C122S/G151N/Q175R/Q192A | 592 |
| F99L/C122S/G151N/Q192T | 593 |
| I41D/F99L/C122S/G151N | 594 |
| I41S/F99L/C122S/Q175P/Q192V | 595 |
| I41S/F99L/C122S/G151N/Q175P | 596 |
| I41E/F99L/C122S/Q175G/Q192T | 597 |
| I41E/F99L/C122S/G151N/Q175G | 598 |
| I41D/Y59F/F99L/C122S/G151N/Q192T/N213A | 599 |
| I41D/G43A/F99L/C122S/G151N/Q192T/P232S/K239R | 600 |
| I41D/G43A/D96E/F99L/C122S/G151N/Q192T | 601 |
| I41D/D96E/F99L/C122S/G151N/Q192T | 602 |
| I41D/D96E/C122S/G151N/Q192T | 603 |
| I41D/D96E/F99L/C122S/G151N/Q192T/D217E | 604 |
| I41D/F99L/M117T/C122S/G151N/Q192T/A204D/D217E | 605 |
| I41D/F99L/C122S/G151N/Q192T/D217E | 606 |

TABLE 12a-continued

Modified MTSP-1 Polypeptides

| Chymotrypsin numbering | SEQ ID NO |
|---|---|
| I41D/F99L/C122S/I136M/G151N/Q192T/D217L/K224R | 607 |
| I41D/F60eI/D96E/F99L/C122S/G151N/Q192T | 608 |
| I41D/C122S/G151N/Q192T/D217E | 609 |
| D96E/C122S/G151N/Q192T | 610 |
| Y59F/C122S/G151N/Q192T | 611 |
| Q38H/I41S/D60bT/F60eS/Y60gW/D96K/F97G/F99L/C122S/G151H/Q175L/Q192D | 612 |
| I41S/ins97aV/C122S/Q192D | 613 |
| I41S/F97L/F99L/C122S/Q192S | 614 |
| I41T/F97R/ins97aV/T98L/C122S/Q192S | 615 |
| I41S/F97V/T98N/F99L/C122S/Q192S | 616 |
| I41S/F97G/ins97aA/T98L/C122S/Q192A | 617 |
| I41S/F97D/F99L/C122S/Q192V | 618 |
| I41E/F97L/F99L/C122S/Q192A | 619 |
| I41S/F97A/ins97aV/T98L/C122S/Q192A | 620 |
| I41S/F97del/T98S/F99L/C122S/Q192S | 621 |
| I41A/Y60gW/D96F/F97G/F99M/C122S/Q175W/Q192A | 622 |
| I41G/Y60gW/F99L/C122S/Q175R/Q192S | 623 |
| I41A/Y60gW/ins97aE/F99L/C122S/Q175M/Q192T | 624 |
| I41T/ins97aA/F99Y/C122S/Q175L/Q192A | 625 |
| I41A/ins97aY/F99L/C122S/Q175R/Q192H | 626 |
| I41S/ins97aT/F99L/C122S/Q175R/Q192H | 627 |
| I41S/Y60gW/ins97aN/F99L/C122S/Q175R/Q192T | 628 |
| Q38H/I41S/D96S/ins97aK/C122S/G151N/Q192A | 629 |
| Q38H/I41A/D96A/ins97aA/C122S/G151D/Q192T | 630 |
| Q38H/I41S/D96Q/ins97aT/C122S/G151N/Q192A | 631 |
| Q38H/I41T/D96M/ins97aA/C122S/G151D | 632 |
| Q38Y/I41A/D96I/ins97aQ/C122S | 633 |
| Q38H/I41S/D96K/ins97aT/C122S/G151K/Q192A | 634 |
| Q38W/I41S/D96R/ins97aA/C122S/G151N/Q192A | 635 |
| Q38H/I41A/D96R/ins97aQ/C122S | 636 |
| Q38F/I41V/D96Q/ins97aT/C122S/G151D | 637 |
| L33M/Q38F/I41S/D96A/ins97aW/C122S/G151N/Q192S | 638 |
| Q38H/I41S/D96V/ins97aA/C122S/G151N/Q192A | 639 |
| Q38H/I41T/D96K/ins97aL/C122S/G151N/Q192A | 640 |
| Q38H/I41S/D96Q/ins97aA/C122S/Q192T | 641 |
| Q38W/I41V/D96R/ins97aA/C122S/G151N | 642 |
| Q38Y/I41T/D96M/ins97aS/C122S/G151N | 643 |
| Q38H/I41S/D96K/ins97aS/C122S/G151P/Q192S | 644 |
| Q38H/I41S/D96G/ins97aG/C122S/G151N/Q192A | 645 |
| Q38H/I41S/D96K/ins97aD/C122S/G151N/Q192S | 646 |
| I41S/D96E/ins97aG/C122S/G151Q/Q192A | 647 |
| I41S/Y59F/ins97aV/C122S/G187D/Q192D/D217V | 648 |
| A35V/I41S/Y59F/C122S/Q192D/D217V | 649 |
| I41S/F93L/ins97aV/C122S/Q192V/D217V | 650 |
| I41S/S90P/ins97aV/C122S/Y146E/Q192N/D217V | 651 |
| I41S/S90T/ins97aV/C122S/Q192N/D217V | 652 |
| I41S/S90T/ins97aV/C122S/Q192V/D217V | 653 |
| I41S/Y59F/ins97aV/C122S/Q192G | 654 |
| I41S/Y59F/F97S/ins97aV/S116Y/C122S/Q192G/D217V | 655 |
| I41S/ins97aV/C122S/Q192G/Q209L | 656 |
| Q38H/I41S/ins97aV/A112V/C122S/Q192A/Q209L | 657 |
| I41S/ins97aV/C122S/Q192V/D217V | 658 |
| I41S/Y59F/ins97aV/C122S/Q192A | 659 |
| I41A/F97G/ins97aM/T98L/C122S | 660 |
| I41G/F97E/F99L/C122S/Q192A | 661 |
| I41S/F97V/ins97aV/T98P/C122S | 662 |
| I41S/T98S/F99L/C122S/Q192A | 663 |
| I41G/F97Q/F99L/C122S/Q192S | 664 |
| I41G/F97L/F99L/C122S/Q192S | 665 |
| I41S/F97G/ins97aA/T98P/C122S/Q192A | 666 |
| I41A/F97G/ins97aV/T98E/C122S | 667 |
| I41A/F97S/ins97aA/C122S | 668 |
| I41A/F97W/T98S/F99L/C122S/Q192A | 669 |
| I41L/N95D/D96T/F97W/F99L/C122S/Q192A | 670 |
| I41T/Y60gL/N95D/D96F/F97S/F99L/C122S/Q175S/Q192A | 671 |
| I41A/Y60gW/N95D/D96F/F97G/F99L/C122S/Q175H/Q192A | 672 |
| I41A/Y60gW/F99L/C122S/Q175T/Q192A | 673 |
| Q38M/I41T/D96M/ins97aH/C122S/G151E | 674 |
| Q38H/I41T/D96R/ins97aG/C122S/G151S | 675 |
| I41S/D60bY/ins97aV/T98N/C122S/Q192H | 676 |
| I41S/Y59F/D60bY/ins97aV/C122S/Q192G | 677 |
| I41S/D60bY/ins97aV/A112V/C122S/Q192G/Q209L | 678 |
| A35T/I41S/Y59F/ins97aV/C122S/Y146F/N183A/Q192G/R235H | 679 |
| I41S/D96K/F97G/ins97aV/T98P/F99L/C122S/Q175H/Q192D | 680 |
| I41S/ins97aV/C122S/N164D/Q192G/R235H | 681 |

TABLE 12a-continued

Modified MTSP-1 Polypeptides

| Chymotrypsin numbering | SEQ ID NO |
|---|---|
| I41S/Y59F/ins97aV/C122S/Q192G/N223D | 682 |
| I41S/ins97aV/C122S/N164D/Q192G/R235L | 683 |
| I41S/Y59F/F97Y/ins97aV/C122S/Q192G | 684 |
| I41S/D96K/F97G/ins97aV/T98P/F99L/C122S/Q192V | 685 |
| I41S/F99L/C122S/G151N/Q175M/Q192G/D217V | 686 |
| I41S/F97L/F99L/C122S/G151N/Q192G/D217V | 687 |
| I41S/F97S/F99L/C122S/G151N/Q175L/Q192A/D217L | 688 |
| I41G/F97R/F99L/C122S/G151N/Q175L/Q192S/D217V | 689 |
| I41T/F97L/F99L/C122S/G151N/Q175S/Q192S/D217W | 690 |
| I41D/F97T/F99M/C122S/Q192V/D217M | 691 |

TABLE 12b

Modified MTSP-1 Polypeptides

| Mature MTSP-1 numbering | Chymotrypsin numbering | SEQ ID NO |
|---|---|---|
| I640R/F706T/InsE/T707G/F708L/C731S/G759N/Q783L/Q802E | I41R/F97T/Ins97aE/T98G/F99L/C122S/G151N/Q175L/Q192E | 21 |
| Q637H/I640A/D661V/F664R/Y666W/F706T/InsE/T707G/F708L/C731S/G759N/Q783L/Q802D | Q38H/I41A/D60bV/F60eR/Y60gW/F97T/ins97aE/T98G/F99L/C122S/G151N/Q175L/Q192D | 22 |
| Q637H/I640A/D661T/F664K/Y666W/F706T/InsE/T707G/F708L/C731S/G759N/Q783L/Q802D | Q38H/I41A/D60bT/F60eK/Y60gW/F97T/ins97aE/T98G/F99L/C122S/G151N/Q175L/Q192D | 23 |
| Q637H/I640S/D661T/F664S/Y666W/F706D/InsV/T707P/F708L/C731S/G759H/Q783L/Q802E | Q38H/I41S/D60bT/F60eS/Y60gW/F97D/ins97aV/T98P/F99L/C122S/G151H/Q175L/Q192E | 24 |
| Q637H/I640S/D661T/F664S/Y666W/F706D/InsV/T707P/F708L/C731S/G759H/Q783L/Q802D | Q38H/I41S/D60bT/F60eS/Y60gW/F97D/ins97aV/T98P/F99L/C122S/G151H/Q175L/Q192D | 25 |
| Q637H/I640A/D661T/F664K/Y666W/F706T/InsE/T707G/F708L/C731S/G759N/Q783L/Q802D | Q38H/I41A/D60bT/F60eK/Y60gW/F97T/ins97aE/T98G/F99L/C122S/G151H/Q175L/Q192D | 26 |
| Q637H/I640S/D661T/F664S/Y666W/F706D/InsV/T707P/F708L/C731S/G759N/Q783L/Q802D | Q38H/I41S/D60bT/F60eS/Y60gW/F97D/ins97aV/T98P/F99L/C122S/G151N/Q175L/Q192D | 27 |
| Q637H/I640A/D661V/F664R/Y666W/F706T/InsE/T707G/F708L/C731S/G759H/Q783L/Q802DQ175L/Q192D | Q38H/I41A/D60bV/F60eR/Y60gW/F97T/ins97aE/T98G/F99L/C122S/G151H/ | 28 |
| Q637H/I640A/D661V/F664R/Y666W/D705I/F706Y/InsN/T707G/F708L/C731S/G759N/Q783L/Q802D | Q38H/I41A/D60bV/F60eR/Y60gW/D96I/F97Y/ins97aN/T98G/F99L/C122S/G151N/Q175L/Q192D | 29 |
| Q637H/I640S/D661T/F664S/Y666W/D705K/F706D/InsA/T707P/F708L/C731S/G759H/Q783L/Q802D | Q38H/I41S/D60bT/F60eS/Y60gW/D96K/F97D/ins97aA/T98P/F99L/C122S/G151H/Q175L/Q192D | 30 |
| Q637H/I640A/D661V/F664R/Y666W/D705P/F706W/InsN/T707G/F708L/C731S/G759N/Q783L/Q802E | Q38H/I41A/D60bV/F60eR/Y60gW/D96P/F97W/ins97aN/T98G/F99L/C122S/G151N/Q175L/Q192E | 31 |
| Q637H/I640A/D661V/F664R/Y666W/D705I/F706N/T707G/F708L/C731S/G759N/Q783L/Q802D | Q38H/I41A/D60bV/F60eR/Y60gW/D96I/F97N/T98G/F99L/C122S/G151N/Q175L/Q192D | 32 |
| Q637H/I640S/D661T/F664S/Y666W/D705Y/F706E/InsV/T707G/F708L/C731S/G759H/Q783L/Q802D | Q38H/I41S/D60bT/F60eS/Y60gW/D96Y/F97E/ins97aV/T98G/F99L/C122S/G151H/Q175L/Q192D | 33 |
| Q637H/I640S/D661T/F664S/Y666W/D705L/F706D/InsG/T707N/F708L/C731S/G759H/Q783L/Q802E | Q38H/I41S/D60bT/F60eS/Y60gW/D96L/F97D/ins97aG/T98N/F99L/C122S/G151H/Q175L/Q192E | 34 |
| Q637H/I640S/D661T/F664S/Y666W/D705K/F706G/InsV/T707P/F708L/C731S/G759H/Q783L/Q802D | Q38H/I41S/D60bT/F60eS/Y60gW/D96K/F97G/ins97aV/T98P/F99L/C122S/G151H/Q175L/Q192D | 35 |
| Q637H/I640S/D661T/F664S/Y666W/D705V/F706G/InsV/T707P/F708L/C731S/G759H/Q783L/Q802D | Q38H/I41S/D60bT/F60eS/Y60gW/D96V/F97G/ins97aV/T98P/F99L/C122S/G151H/Q175L/Q192D | 36 |
| Q637H/I640S/D661T/F664S/Y666W/D705K/F706D/InsA/T707P/F708L/C731S/G759N/Q783L/Q802D | Q38H/I41S/D60bT/F60eS/Y60gW/D96K/F97D/ins97aA/T98P/F99L/C122S/G151N/Q175L/Q192D | 37 |
| Q637H/I640S/D661T/F664S/Y666W/F706G/InsV/T707P/F708L/C731S/G759H/Q783L/Q802D | Q38H/I41S/D60bT/F60eS/Y60gW/F97G/ins97aV/T98P/F99L/C122S/G151H/Q175L/Q192D | 38 |

TABLE 12b-continued

Modified MTSP-1 Polypeptides

| Mature MTSP-1 numbering | Chymotrypsin numbering | SEQ ID NO |
|---|---|---|
| Q637H/I640S/D661T/F664S/Y666W/D705K/InsV/T707P/F708L/C731S/G759H/Q783L/Q802D | Q38H/I41S/D60bT/F60eS/Y60gW/D96K/ins97aV/T98P/F99L/C122S/G151H/Q175L/Q192D | 39 |
| Q637H/I640S/D661T/F664S/Y666W/D705K/F706G/InsV/T707P/F708L/C731S/G759H/Q783L | Q38H/I41S/D60bT/F60eS/Y60gW/D96K/F97G/ins97aV/T98P/F99L/C122S/G151H/Q175L | 40 |
| I640E/F708L/C731S/G759N/Q802T | I41E/F99L/C122S/G151N/Q192T | 41 |
| I640D/C731S/G759N/Q802T | I41D/C122S/G151N/Q192T | 42 |
| I640S/F708L/C731S/G759N/Q802V | I41S/F99L/C122S/G151N/Q192V | 43 |
| I640E/F708L/C731S/G759N/Q802T | I41E/F99L/C122S/G151N/Q192T | 44 |
| I640D/Y658F/D705E/F708L/C731S/G759N/Q802T | I41D/Y59F/D96E/F99L/C122S/G151N/Q192T | 45 |
| I640D/Y658F/C731S/G759N/Q802T | I41D/Y59F/C122S/G151N/Q192T | 46 |
| I640S/D661T/F664S/Y666W/D705K/F706G/InsV/T707P/F708L/C731S/G759H/Q783L/Q802D | I41S/D60bT/F60eS/Y60gW/D96K/F97G/ins97aV/T98P/F99L/C122S/G151H/Q175L/Q192D | 47 |
| Q637H/D661T/F664S/Y666W/D705K/F706G/InsV/T707P/F708L/C731S/G759H/Q783L/Q802D | Q38H/D60bT/F60eS/Y60gW/D96K/F97G/ins97aV/T98P/F99L/C122S/G151H/Q175L/Q192D | 48 |
| Q637H/I640S/F664S/Y666W/D705K/F706G/InsV/T707P/F708L/C731S/G759H/Q783L/Q802D | Q38H/I41S/F60eS/Y60gW/D96K/F97G/ins97aV/T98P/F99L/C122S/G151H/Q175L/Q192D | 49 |
| Q637H/I640S/D661T/Y666W/D705K/F706G/InsV/T707P/F708L/C731S/G759H/Q783L/Q802D | Q38H/I41S/D60bT/Y60gW/D96K/F97G/ins97aV/T98P/F99L/C122S/G151H/Q175L/Q192D | 50 |
| Q637H/I640S/D661T/F664S/D705K/F706G/InsV/T707P/F708L/C731S/G759H/Q783L/Q802D | Q38H/I41S/D60bT/F60eS/D96K/F97G/ins97aV/T98P/F99L/C122S/G151H/Q175L/Q192D | 51 |
| Q637H/I640S/D661T/F664S/Y666W/D705K/F706G/T707P/F708L/C731S/G759H/Q783L/Q802D | Q38H/I41S/D60bT/F60eS/Y60gW/D96K/F97G/T98P/F99L/C122S/G151H/Q175L/Q192D | 52 |
| Q637H/I640S/D661T/F664S/Y666W/D705K/F706G/InsV/F708L/C731S/G759H/Q783L/Q802D | Q38H/I41S/D60bT/F60eS/Y60gW/D96K/F97G/ins97aV/F99L/C122S/G151H/Q175L/Q192D | 53 |
| Q637H/I640S/D661T/F664S/Y666W/D705K/F706G/InsV/T707P/C731S/G759H/Q783L/Q802D | Q38H/I41S/D60bT/F60eS/Y60gW/D96K/F97G/ins97aV/T98P/C122S/G151H/Q175L/Q192D | 54 |
| Q637H/I640S/D661T/F664S/Y666W/D705K/F706G/InsV/T707P/F708L/C731S/Q783L/Q802D | Q38H/I41S/D60bT/F60eS/Y60gW/D96K/F97G/ins97aV/T98P/F99L/C122S/Q175L/Q192D | 55 |
| Q637H/I640S/D661T/F664S/Y666W/D705K/F706G/InsV/T707P/F708L/C731S/G759H/Q802D | Q38H/I41S/D60bT/F60eS/Y60gW/D96K/F97G/ins97aV/T98P/F99L/C122S/G151H/Q192D | 56 |
| Q637H/I640S/D705K/F706G/InsV/T707P/F708L/C731S/Q802D | Q38H/I41S/D96K/F97G/ins97aV/T98P/F99L/C122S/Q192D | 57 |
| I640S/D705K/F706G/InsV/T707P/F708L/C731S/Q783L/Q802D | I41S/D96K/F97G/ins97aV/T98P/F99L/C122S/Q175L/Q192D | 58 |
| Q637H/I640S/D705K/F706G/InsV/T707P/F708L/C731S/Q783L/Q802D | Q38H/I41S/D96K/F97G/ins97aV/T98P/F99L/C122S/Q175L/Q192D | 59 |
| I640S/D705K/F706G/InsV/T707P/F708L/C731S/Q802D | I41S/D96K/F97G/ins97aV/T98P/F99L/C122S/Q192D | 63 |
| Q637H/I640S/D705K/F706G/InsV/T707P/F708L/C731S/Q783L/Q802D | Q38H/I41S/D96K/F97G/ins97aV/T98P/F99L/C122S/Q175L/Q192D | 64 |
| Q637H/I640S/D661Y/D705K/F706G/InsV/T707P/F708L/C731S/Q802D/D828V | Q38H/I41S/D60bY/D96K/F97G/ins97aV/T98P/F99L/C122S/Q192D/D217V | 65 |
| I640S/D705K/F706G/InsV/T707P/F708L/C731S/Q802G/D828V | I41S/D96K/F97G/ins97aV/T98P/F99L/C122S/Q192G/D217V | 66 |
| I640S/D661Y/D705K/F706G/InsV/T707P/F708L/C731S/Q802D/D828V | I41S/D60bY/D96K/F97G/ins97aV/T98P/F99L/C122S/Q192D/D217V | 67 |
| I640S/D705M/F706G/InsV/T707P/F708L/C731S/Q802G/D828V | I41S/D96M/F97G/ins97aV/T98P/F99L/C122S/Q192G/D217V | 68 |
| I640S/D705K/F706G/InsV/T707P/F708L/C731S/Q802V/D828I | I41S/D96K/F97G/ins97aV/T98P/F99L/C122S/Q192V/D217I | 69 |
| I640S/D705K/F706G/InsV/T707P/F708L/C731S/Q802H | I41S/D96K/F97G/ins97aV/T98P/F99L/C122S/Q192H | 70 |
| I640S/D705K/F706G/InsV/T707P/F708L/C731S/Q802N/D828V | I41S/D96K/F97G/ins97aV/T98P/F99L/C122S/Q192N/D217V | 71 |
| I640S/D661Y/D705K/F706G/InsV/T707P/F708L/C731S/Q783L/Q802D | I41S/D60bY/D96K/F97G/ins97aV/T98P/F99L/C122S/Q175L/Q192D | 72 |
| Q637H/I640S/D705K/F706G/InsV/T707P/F708L/C731S/Q802G/D828V | Q38H/I41S/D96K/F97G/ins97aV/T98P/F99L/C122S/Q192G/D217V | 73 |
| I640S/D705K/F706G/InsV/T707P/F708L/C731S/Q783L/Q802V | I41S/D96K/F97G/ins97aV/T98P/F99L/C122S/Q175L/Q192V | 74 |

TABLE 12b-continued

Modified MTSP-1 Polypeptides

| Mature MTSP-1 numbering | Chymotrypsin numbering | SEQ ID NO |
|---|---|---|
| I640S/P648S/D705K/F706G/InsV/T707P/F708L/C731S/Q802G/D828V | I41S/P49S/D96K/F97G/ins97aV/T98P/F99L/C122S/Q192G/D217V | 75 |
| I640S/D705K/F706G/InsV/T707P/F708L/C731S/Q783L/Q802N/D828V | I41S/D96K/F97G/ins97aV/T98P/F99L/C122S/Q175L/Q192N/D217V | 76 |
| I640T/F706W/F708L/C731S/G759N/Q783 | I41T/F97W/F99L/C122S/G151N/Q175M/Q802G/D828LM/Q192G/D217L | 77 |
| I640G/F706L/F708L/C731S/Q783A/Q802T/D828V | I41G/F97L/F99L/C122S/Q175A/Q192T/D217V | 78 |
| I640G/F706V/F708L/C731S/G759Q/Q783M/Q802A/D828L | I41G/F97V/F99L/C122S/G151Q/Q175M/Q802A/D828LM/Q192A/D217L | 79 |
| I640G/F7061/F708L/C731S/G759L/Q783M/Q802S/D828V | I41G/F971/F99L/C122S/G151L/Q175M/Q192S/D217V | 80 |
| I640G/F706S/F708L/C731S/G759N/Q783L/Q802G/D8281 | I41G/F97S/F99L/C122S/G151N/Q175L/Q192G/D217I | 81 |

2. Additional Modifications

Any of the modified MTSP-1 polypeptides provided herein can contain any one or more additional modifications. The additional modifications can include, for example, any amino acid substitution, deletion or insertion known in the art, typically any that increase specificity of a modified MTSP-1 polypeptide for inactivation cleavage of complement protein C3 compared to an unmodified or reference MTSP-1 polypeptide, such as the protease domain. Any modified MTSP-1 polypeptide provided herein can contain 1, 2, 3, 4, 5, 6, 7, 8, 9, 10, 11, 12, 13, 14, 15, 16, 17, 18, 19, 20 or more additional amino acid modifications. Also, contemplated are modifications that alter any other activity of interest. It is long known in the art that amino acid modifications of the primary sequence are additive (see, e.g., Wells (1990) Biochem 29:8509-8517). Examples of additional modifications that can be included in the modified MTSP-1 polypeptides provided herein include, but are not limited to, those described in U.S. Pat. Nos. 7,939,304; 8,211,428; 8,445,245; 9,290,757; 9,359,598; 8,663,633; U.S. Patent Publication Nos. 2003/0119168; 2007/0093443; 2010/0189652; 2010/0105121; 2012/0244139; 2014/0242062; 2004/0146938; and 2009/0136477; Miyake et al. (2010) Biochim BioPhys Acta 1804(1):156-165; List et al. (2007) J. Biol. Chem. 282(50):36714-23; Desilets et al. (2008) J. Biol. Chem. 283(16):10535-10542; Szabo (2009) Am J Pathol. 174(6):2015; Vanagaite et al. (2007) Am J Hum Genet. 80(3):467; Alef et al. (2009) J Invest Dermatol. 129(4):862; Ge et al. (2006) J. Biol. Chem. 281:7406; Takeuchi et al. (1999) PNAS 96(20):11054-61; Oberst et al. (2003) J. Biol. Chem. 29(18):26773; and International Patent Publication Nos. WO 2015/166427 and WO 2015/085395. Non-limiting examples of exemplary amino acid modifications described in the art include any one or more of R85H, N109Q, G149N, D251E, N302Q, Q348H, G349Y, R381S, P452R, D482Y, N485Q, D519Y, S524M, D555Y, C574R, D598Y, K600R, C602S, C604S, V615I, V616L, V616G, G617N, G617L, G618L, D622E, Q637D, I640T, I640A, I640L, I640F, I640D, I640E, C641S, L651M, H656A, C657S, D661I, D661F, D661R, D661A, R662F, R662D, R662A, R662W, Y666S, T673K, A674V, H679R, S685R, F702L, N704K, D705A, D705V, D705F, D705S, D705T, F706N, F706D, F706E, F706A, F706W, F706R, F706Y, F706L, T707P, F708Y, F708W, F708N, F708D, F708E, F708A, F708V, F708R, F708I, F708L, F708T, F708S, F708G, D711A, C731S, A735T, V738D, P740S, I745T, I745V, H752R, T753I, T755F, T755N, T755D, T755E, T755A, T755W, T755R, G756E, G759L, I762V, N772Q, N772D, T774A, T775P, C776S, L779F, L780N, L780D, L780E, L780A, L780V, L780F, L780R, P781S, Q780N, Q780D, Q780E, Q780A, Q780V, Q780F, Q780R, P781S, Q782H, Q782A, Q782V, Q782F, Q782R, Q782K, Q782L, Q782Y, Q783D, Q783E, Q783A, Q783V, Q783H, Q783H, Q783L, Q783F, Q783W, Q783Y, Q783R, Q783K, M788E, M788Y, M788R, M788A, C790S, F793L, C801S, Q802A, Q802V, Q802D, Q802R, Q802F, Q802X, Q802L, Q802I, Q802E, Q802K, Q802Y, Q802H, S805A, S811I, Q820L, W826F, W826Y, W826I, W826D, W826R, W826X, G827R, D828A, D828V, D828F, D828E, D828R, D828Q, D828N, D828H, C830S, Q832D, Q832L, Q832E, K835A, K835F, K835V, K835D, K835L, K835R, K835N, K835T, K835Y, K835S, K835F, R841W, F845L, and V855G, according to the sequence of amino acids set forth in SEQ ID NO:1. Additional modifications includes amino acid replacements that introduce a glycosylation site.

The modified MTSP-1 polypeptides include those that contain chemical or post-translational modifications. In some examples, modified MTSP-1 polypeptides provided herein do not contain chemical or post-translational modifications. Chemical and post-translational modifications include, but are not limited to, PEGylation, sialylation, albumination, glycosylation, farnesylation, carboxylation, hydroxylation, phosphorylation, and other polypeptide modifications known in the art. Also, in addition to any one or more amino acid modifications, such as amino acid replacements, provided herein, modified MTSP-1 polypeptides provided herein can be conjugated or fused to any moiety using any method known in the art, including chemical and recombinant methods, providing the resulting polypeptide retains the ability to effect inhibitory or inactivation cleavage of complement protein C3.

For example, in addition to any one or more amino acid modifications, such as amino acid replacements, provided herein, modified MTSP-1 polypeptides provided herein also can contain other modifications that are or are not in the primary sequence of the polypeptide, including, but not limited to, modification with a carbohydrate moiety, a polyethylene glycol (PEG) moiety, a sialylation moiety, an Fc domain from immunoglobulin G, or any other domain or moiety. For example, such additional modifications can be made to increase the stability or serum half-life of the protein.

a. Decreased Immunogenicity

The modified MTSP-1 polypeptides provided herein can be modified to have decreased immunogenicity. Decreased immunogenicity can be effected by sequence changes that eliminate antigenic epitopes from the polypeptide or by altering post-translational modifications. One of skill in the art is familiar with methods of identifying antigenic epitopes in a polypeptide (see, e.g., Liang et al. (2009) *BMC Bioinformatics*, 10:302; Yang et al. (2009) *Rev. Med. Virol.,* 19:77-96). In some examples, one or more amino acids can be modified in order to remove or alter an antigenic epitope. In another example, altering the glycosylation of a protein also can affect immunogenicity. For example, altering the glycosylation of the peptide is contemplated, so long as the polypeptides retain the ability to effect inhibitory or inactivation cleavage of complement protein C3. Glycosylation sites can be removed by single mutations. Glycosylation sites can be added by introducing a canonical sequence, such as by insertion or single or a plurality of mutations, such as NXS(T), where X is not a proline. Glycosylation sites also can increase serum half-life.

b. Fc Domains

The modified MTSP-1 polypeptides can be linked to the Fc region of an immunoglobulin polypeptide. Typically, such a fusion retains at least a functionally active hinge, $C_H2$ and $C_H3$ domains of the constant region of an immunoglobulin heavy chain. For example, a full-length Fc sequence of IgG1 includes amino acids 99-330 of the sequence set forth in the SEQ ID NO: 100. An exemplary Fc sequence for hIgG1 is set forth in SEQ ID NO: 101. It contains almost all of the hinge sequence corresponding to amino acids 100-110 of SEQ ID NO:100; the complete sequence for the $C_H2$ and $C_H3$ domain as set forth in SEQ ID NO:100.

Another exemplary Fc polypeptide is set forth in International Patent Publication No. WO 93/10151, and is a single chain polypeptide extending from the N-terminal hinge region to the native C-terminus of the Fc region of a human IgG1 antibody (SEQ ID NO:100). The precise site at which the linkage is made is not critical: particular sites are well known and can be selected in order to optimize the biological activity, secretion, or binding characteristics of the HABP polypeptide. For example, other exemplary Fc polypeptide sequences begin at amino acid C109 or P113 of the sequence set forth in SEQ ID NO: 101 (see e.g., U.S. Pub. No. 2006/0024298).

In addition to hIgG1 Fc, other Fc regions also can be used. For example, where effector functions mediated by Fc/FcγR interactions are to be minimized, fusion with IgG isotypes that poorly recruit complement or effector cells, such as for example, the Fc of IgG2 or IgG4, is contemplated. Additionally, the Fc fusions can contain immunoglobulin sequences that are substantially encoded by immunoglobulin genes belonging to any of the antibody classes, including, but not limited to IgG (including human subclasses IgG1, IgG2, IgG3, or IgG4), IgA (including human subclasses IgA1 and IgA2), IgD, IgE, and IgM classes of antibodies. Linkers can be used to covalently link Fc to another polypeptide to generate a Fc chimera.

Modified Fc domains also are well known. In some examples, the Fc region is modified such that it exhibits altered binding to an FcR resulting in altered (i.e. more or less) effector function than the effector function of an Fc region of a wild-type immunoglobulin heavy chain. Thus, a modified Fc domain can have altered affinity, including but not limited to, increased or low or no affinity for the Fc receptor. For example, the different IgG subclasses have different affinities for the FcγRs, with IgG1 and IgG3 typically binding substantially better to the receptors than IgG2 and IgG4. In addition, different FcγRs mediate different effector functions. FcγR1, FcγRIIa/c, and FcγRIIIa are positive regulators of immune complex triggered activation, characterized by having an intracellular domain that has an immunoreceptor tyrosine-based activation motif (ITAM). FcγRIIb, however, has an immunoreceptor tyrosine-based inhibition motif (ITIM) and is therefore inhibitory. Altering the affinity of an Fc region for a receptor can modulate the effector functions and/or pharmacokinetic properties associated by the Fc domain. Modified Fc domains are known to one of skill in the art and described in the literature, see e.g., U.S. Pat. No. 5,457,035; U.S. Patent Publication No. US 2006/0024298; and International Patent Publication No. WO 2005/063816 for exemplary modifications.

The resulting chimeric polypeptides containing Fc moieties, and multimers formed therefrom, can be easily purified by affinity chromatography over Protein A or Protein G columns.

c. Conjugation to Polymers

In some examples, the modified MTSP-1 polypeptides provided herein are conjugated to polymers. Polymers can increase the size of the polypeptide to reduce kidney clearance and thereby increase half-life or to modify the structure of the polypeptide to increase half-life or reduce immunogenicity. Exemplary polymers that can be conjugated to the MTSP-1 polypeptides, include natural and synthetic homopolymers, such as polyols (i.e., poly-OH), polyamines (i.e., poly-NH$_2$) and polycarboxylic acids (i.e., poly-COOH), and other heteropolymers i.e. polymers comprising one or more different coupling groups e.g. a hydroxyl group and amine groups. Examples of suitable polymeric molecules include polymeric molecules selected from among polyalkylene oxides (PAO), such as polyalkylene glycols (PAG), including polyethylene glycols (PEG), methoxy-polyethylene glycols (mPEG) and polypropylene glycols, PEG-glycidyl ethers (Epox-PEG), PEG-oxycarbonylimidazole (CDI-PEG), branched polyethylene glycols (PEGs), polyvinyl alcohol (PVA), polycarboxylates, polyvinylpyrrolidone, poly-D,L-amino acids, polyethylene-co-maleic acid anhydride, polystyrene-co-maleic acid anhydride, dextrans including carboxymethyl-dextrans, heparin, homologous albumin, celluloses, including methylcellulose, carboxymethylcellulose, ethylcellulose, hydroxyethylcellulose, carboxyethylcellulose and hydroxypropylcellulose, hydrolysates of chitosan, starches such as hydroxyethyl-starches and hydroxypropyl-starches, glycogen, agaroses and derivatives thereof, guar gum, pullulan, inulin, xanthan gum, carrageenan, pectin, alginic acid hydrolysates and bio-polymers.

Typically, the polymers are polyalkylene oxides (PAO), such as polyethylene oxides, such as PEG, typically mPEG, which have few reactive groups capable of cross-linking. Typically, the polymers are non-toxic polymeric molecules such as (methoxy)polyethylene glycol (mPEG) which can be covalently conjugated to the MTSP-1 polypeptides (e.g., to attachment groups on the protein surface) using a relatively simple chemistry.

Suitable polymeric molecules for attachment to the MTSP-1 polypeptides include, but are not limited to, polyethylene glycol (PEG) and PEG derivatives such as methoxy-polyethylene glycols (mPEG), PEG-glycidyl ethers (Epox-PEG), PEG-oxycarbonylimidazole (CDI-PEG), branched PEGs, and polyethylene oxide (PEO) (see e.g., Roberts et al. (2002) *Advanced Drug Delivery Review* 54: 459-476; Harris and Zalipsky (eds.) "Poly(ethylene glycol), Chemistry and Biological Applications" ACS Symposium Series 680, 1997; Mehvar et al. (2000) *J. Pharm. Pharmaceut. Sci.*, 3(1):-136; Harris and Chess (2003) *Nat Rev Drug Discov.* 2(3):214-21; and Tsubery (2004), *J Biol. Chem* 279(37):38118-24). The polymeric molecule can be of a molecular weight typically ranging from about 3 kDa to about 60 kDa. In some embodiments the polymeric molecule that is conjugated to a MTSP-1 polypeptide provided herein has a molecular weight of 5, 10, 15, 20, 25, 30, 35, 40, 45, 50, 55, 60 or more than 60 kDa.

Methods of modifying polypeptides by covalently attaching (conjugating) a PEG or PEG derivative (i.e., "PEGylation") are well known in the art (see e.g., U.S. 2006/0104968; U.S. Pat. Nos. 5,672,662; 6,737,505; and U.S. 2004/0235734). Techniques for PEGylation include, but are not limited to, specialized linkers and coupling chemistries (see e.g., Harris (2002) *Adv. Drug Deliv. Rev.* 54:459-476), attachment of multiple PEG moieties to a single conjugation site (such as via use of branched PEGs; see e.g., Veronese et al. (2002) *Bioorg. Med. Chem. Lett.* 12:177-180), site-specific PEGylation and/or mono-PEGylation (see e.g., Chapman et al. (1999) *Nature Biotech.* 17:780-783), and site-directed enzymatic PEGylation (see e.g., Sato, *Adv. Drug Deliv. Rev.*, 54:487-504, 2002) (see, also, for example, Lu and Felix (1994) *Int. J. Peptide Protein Res.* 43:127-138; Lu and Felix (1993) *Peptide Res.* 6:142-6, 1993; Felix et al. (1995) *Int. J. Peptide Res.* 46:253-64; Benhar et al. (1994) *J. Biol. Chem.* 269:13398-404; Brumeanu et al. (1995) *J Immunol.* 154:3088-95; see also, Caliceti et al. (2003) *Adv. Drug Deliv. Rev.* 55(10):1261-77 and Molineux (2003) *Pharmacotherapy* 23 (8 Pt 2):3S-8S). Methods and techniques described in the art can produce proteins having 1, 2, 3, 4, 5, 6, 7, 8, 9, 10 or more than 10 PEG or PEG derivatives attached to a single protein molecule (see e.g., U.S. 2006/0104968).

Numerous reagents for PEGylation have been described in the art. Such reagents include, but are not limited to, N-hydroxysuccinimidyl (NHS) activated PEG, succinimidyl mPEG, mPEG2-N-hydroxysuccinimide, mPEG succinimidyl alpha-methylbutanoate, mPEG succinimidyl propionate, mPEG succinimidyl butanoate, mPEG carboxymethyl 3-hydroxybutanoic acid succinimidyl ester, homobifunctional PEG-succinimidyl propionate, homobifunctional PEG propionaldehyde, homobifunctional PEG butyraldehyde, PEG maleimide, PEG hydrazide, p-nitrophenyl-carbonate PEG, mPEG-benzotriazole carbonate, propionaldehyde PEG, mPEG butryaldehyde, branched mPEG2 butyraldehyde, mPEG acetyl, mPEG piperidone, mPEG methylketone, mPEG "linkerless" maleimide, mPEG vinyl sulfone, mPEG thiol, mPEG orthopyridylthioester, mPEG orthopyridyl disulfide, Fmoc-PEG-NHS, Boc-PEG-NHS, vinylsulfone PEG-NHS, acrylate PEG-NHS, fluorescein PEG-NHS, and biotin PEG-NHS (see e.g., Monfardini et al., (1995) *Bioconjugate Chem.* 6:62-69; Veronese et al. (1997), *J. Bioactive Compatible Polymers* 12:197-207; U.S. Pat. Nos. 5,672,662; 5,932,462; 6,495,659; 6,737,505; 4,002,531; 4,179,337; 5,122,614; 5,183,550; 5,324,844; 5,446,090; 5,612,460; 5,643,575; 5,766,581; 5,795,569; 5,808,096; 5,900,461; 5,919,455; 5,985,263; 5,990,237; 6,113,906; 6,214,966; 6,258,351; 6,340,742; 6,413,507; 6,420,339; 6,437,025; 6,448,369; 6,461,802; 6,828,401; and 6,858,736; U.S. Patent Publication Nos. 2001/0021763; U.S. 2001/0044526; U.S. 2001/0046481; U.S. 2002/0052430; U.S. 2002/0072573; U.S. 2002/0156047; U.S. 2003/0114647; U.S. 2003/0143596; U.S. 2003/0158333; U.S. 2003/0220447; U.S. 2004/0013637; US 2004/0235734; U.S. 2005/000360; U.S. 2005/0114037; U.S. 2005/0171328; and U.S. 2005/0209416; European Patent Nos. EP 01064951 and EP 0822199; and International Patent Publication Nos. WO 00/176640; WO 00/02017; WO 02/49673; WO 94/28024; and WO 01/87925).

d. Protein Transduction Domains

The modified MTSP-1 polypeptides provided herein can be linked, such as a fusion protein containing an antibody, or antigen binding fragment thereof, conjugated to a protein transduction domain (PTD) that increases the retention of the antibody at a target site for therapy, such as a mucosal site, such as the eye. Any PTD can be employed so long as the PTD promotes the binding to target cell surfaces at the therapeutic site (e.g. mucosal site) and/or uptake of the modified MTSP-1 polypeptide by target cells at the therapeutic site (e.g. mucosal site, such as the eye).

Generally, PTDs include short cationic peptides that can bind to the cell surface through electrostatic attachment to the cell membrane and can be uptaken by the cell by membrane translocation (Kabouridis (2003) *TRENDS Biotech* 21(11) 498-503). The PTDs provided generally interact with a target cell via binding to glycosaminoglycans (GAGs), such as for example, hyaluronic acid, heparin, heparan sulfate, dermatan sulfate, keratin sulfate or chondroitin sulfate and their derivatives.

The protein transduction domain can be of any length. Generally the length of the PTD ranges from 5 or about 5 to 100 or about 100 amino acids in length. For example, the length of the PTD can range from 5 or about 5 to 25 or about 25 amino acids in length. In some examples, the PTD is 5, 6, 7, 8, 9, 10, 11, 12, 13, 14, 15, 16, 17, 18, 19, 20, 21, 22, 23, 24 or 25 amino acids in length.

A single PTD or a plurality thereof can be conjugated to a modified MTSP-1 polypeptide. These are advantageously employed for treatment of ocular or ophthalmic disorders, such as diabetic retinopathies or macular degeneration, including AMD. For example, multiple copies of the same PTD (e.g., dimer, trimer, tetramer, pentamer, hexamer, heptamer, octamer, nonamer, decamer or larger multimer) or different PTDs can be conjugated to the modified MTSP-1 polypeptide.

Several proteins and their peptide derivatives possess cell internalization properties. Exemplary PTDs are known in the art and include, but are not limited to, PTDs listed in Table 13 below, including, for example, PTDs derived from human immunodeficiency virus 1 (HIV-1) TAT (SEQ ID NOS:-135; Ruben et al. (1989) *J. Virol.* 63:1-8), the herpes virus tegument protein VP22 (SEQ ID NO: 140; Elliott and O'Hare (1997) *Cell* 88:223-233), the homeotic protein of *Drosophila melanogaster* Antennapedia (Antp) protein (Penetratin PTD; SEQ ID NO: 112; Derossi et al. (1996) *J. Biol. Chem.* 271:18188-18193), the protegrin 1 (PG-1) antimicrobial peptide SynB (e.g., SynB1 (SEQ ID NO: 121), SynB3 (SEQ ID NO: 122), and Syn B4 (SEQ ID NO: 123); Kokryakov et al. (1993) *FEBS Lett.* 327:231-236) and the Kaposi fibroblast growth factor (SEQ ID NO: 105; Lin et al. (1995) *J. Biol. Chem.* 270-14255-14258). Other proteins and their peptide derivatives have been found to possess similar cell internalization properties. The carrier peptides that have been derived from these proteins show little sequence homology with each other, but are all highly cationic and arginine or lysine rich. Indeed, synthetic poly-arginine peptides have been shown to be internalized with a high level of efficiency and can be selected for conjugation to an antibody provided (Futaki et al. (2003) *J. Mol. Recognit.* 16:260-264; Suzuki et al. (2001) *J. Biol. Chem.* 276:5836-5840). The PTD also can be selected from among one or more synthetic PTDs, including but not limited to, transportan (SEQ ID NO: 136; Pooga et al. (1988) *FASEB J.* 12:67-77; Pooga et al. (2001) *FASEB J.* 15:1451-1453), MAP (SEQ ID NO: 103; Oehlke et al. (1998) *Biochim. Biophys. Acta.* 1414: 127-139), KALA (SEQ ID NO: 101; Wyman et al. (1997) *Biochemistry* 36:3008-3017) and other cationic peptides, such as, for example, various β-cationic peptides (Akkarawongsa et al. (2008) *Antimicrob. Agents and Chemother.* 52(6):2120-2129). Additional PTD peptides and variant PTDs also are provided in, for example, U.S. Patent Publication Nos. US 2005/0260756, US 2006/0178297, US 2006/0100134, US 2006/0222657, US 2007/0161595, US 2007/0129305, European Patent Publication No. EP 1867661, PCT Publication Nos. WO 2000/062067, WO 2003/035892, WO 2007/097561, WO 2007/053512 and Table 13 herein (below). Any such PTDs provided herein or known in the art can be conjugated to a provided therapeutic antibody.

TABLE 13

| Known Protein Transduction Domains | | |
|---|---|---|
| Protein Transduction Domain (PTD) | Source Protein | SEQ ID NO |
| TRSSRAGLQFPVGRVHRLLRK | Buforin II | 82 |
| RKKRRRESRKKRRRES | DPV3 | 83 |
| GRPRESGKKRKRKRLKP | DPV6 | 84 |
| GKRKKKGKLGKKRDP | DPV7 | 85 |
| GKRKKKGKLGKKRPRSR | DPV7b | 86 |
| RKKRRRESRRARRSPRHL | DPV3/10 | 87 |
| SRRARRSPRESGKKRKRKR | DPV10/6 | 88 |
| VKRGLKLRHVRPRVTRMDV | DPV1047 | 89 |
| VKRGLKLRHVRPRVTRDV | DPV1048 | 90 |
| SRRARRSPRHLGSG | DPV10 | 91 |
| LRRERQSRLRRERQSR | DPV15 | 92 |
| GAYDLRRRERQSRLRRRERQSR | DPV15b | 93 |
| WEAALAEALAEALAEHLAEALAEALEALAA | GALA | 94 |
| KGSWYSMRKMSMKIRPFFPQQ | Fibrinogen beta chain | 95 |
| KTRYYSMKKTTMKIIPFNRL | Fibrinogen gamma chain precursor | 96 |
| RGADYSLRAVRMKIRPLVTQ | Fibrinogen alpha chain | 97 |
| LGTYTQDFNKFHTFPQTAIGVGAP | hCT(9-32) | 98 |
| TSPLNIHNGQKL | HN-1 | 99 |
| NSAAFEDLRVLS | Influenza virus nucleoprotein (NLS) | 100 |
| WEAKLAKALAKALAKHLAKALAKALKACEA | KALA | 101 |
| VPMLKPMLKE | Ku70 | 102 |
| KLALKLALKALKAALKLA | MAP | 103 |
| GALFLGFLGAAGSTMGAWSQPKKKRKV | MPG | 104 |
| AAVALLPAVLLALLAP | Human Fibroblast growth factor 4 (Kaposi Fibroblast growth factor) | 105 |
| VQRKRQKLM | N50 (NLS of NF-kB P50) | 106 |
| KETWWETWWTEWSQPKKKRKV | Pep-1 | 107 |
| SDLWEMMMVSLACQY | Pep-7 | 108 |
| RQIKIWFQNRRMKWKK | Penetratin | 109 |

TABLE 13-continued

Known Protein Transduction Domains

| Protein Transduction Domain (PTD) | Source Protein | SEQ ID NO |
|---|---|---|
| GRQIKIWFQNRRMKWKK | Penetratin variant | 110 |
| RRMKWKK | Short Penetratin | 111 |
| ERQIKIWFQNRRMKWKK | Penetratin 42-58 | 112 |
| RRRRRRR | Poly Arginine-R7 | 113 |
| RRRRRRRRR | Poly Arginine-R9 | 114 |
| RVIRVWFQNKRCKDKK | pISL | 115 |
| MANLGYWLLALFVTMWTDVGLCKKRPKP | Prion mouse PrPc1-28 | 116 |
| LLIILRRRIRKQAHAHSK | pVEC | 117 |
| LLIILRRRIRKQAHAH | pVEC variant | 118 |
| VRLPPPVRLPPPVRLPPP | SAP | 119 |
| PKKKRKV | SV-40 (NLS) | 120 |
| RGGRLSYSRRRFSTSTGR | SynB1 | 121 |
| RRLSYSRRRF | SynB3 | 122 |
| AWSFRVSYRGISYRRSR | SynB4 | 123 |
| YGRKKRRQRRRPPQ | Tat 47-60 | 124 |
| YGRKKRRQRRR | Tat 47-57 | |
| YGRKKRRQRR | Tat 47-56 | 126 |
| GRKKRRQRR | Tat 48-56 | 127 |
| GRKKRRQRRR | Tat 48-57 | 128 |
| RKKRRQRRR | Tat 49-57 | 129 |
| RKKRRQRR | Tat 49-56 | 130 |
| GRKKRRQRRRPPQ | Tat 48-60 | 131 |
| GRKKR | Tat 48-52 | 132 |
| CFITKALGISYGRKKRRQRRRPPQFSQTHQVSLSKQ | Tat 37-72 | 133 |
| FITKALGISYGRKKRRQRRRPQFSQTHQVSLSKQ | Tat 38-72 | 134 |
| YGRKKRRQRRRPP | Tat 47-59 | 135 |
| GWTLNSAGYLLGKINLKALAALAKKIL | Transportan | 136 |
| AGYLLGKINLKALAALAKKIL | Transportan 10 | 137 |
| GWTLNSAGYLLG | Transportan derivative | 138 |
| INLKALAALAKKIL | Transportan derivative | 139 |
| DAATATRGRSAASRPTERPRAPARSASRPRRPVD | VP22 | 140 |
| DPKGDPKGVTVTVTVTVTGKGDPKPD | VT5 | 141 |
| GALFLGWLGAAGSTMGAWSQPKKKRKV | Signal Sequence-based peptide | 142 |
| KLALKLALKALKAALKLA | Amphiphilic model peptide | 143 |

TABLE 13-continued

Known Protein Transduction Domains

| Protein Transduction Domain (PTD) | Source Protein | SEQ ID NO |
|---|---|---|
| KFFKFFKFFK | Bacterial cell wall permeating | 144 |
| LLGDFFRKSKEKIGKEFKRIVQRIKDFLRNLVPRTES | LL-37 | 145 |
| SWLSKTAKKLENSAKKRISEGIAIAIQGGPR | Cecropin P1 | 146 |
| ACYCRIPACIAGERRYGTCIYQGRLWAFCC | alpha defensin | 147 |
| DHYNCVSSGGQCLYSACPIFTKIQGTCYRGKAKCCK | beta defensin | 148 |
| RKCRIWIRVCR | Bactenecin | 149 |
| RRRPRPPYLPRPRPPPFFPPRLPPRIPPGFPPRFPPRFPGKR | PR-39 | 150 |
| ILPWKWPWWPWRR | Indolicidin | 151 |
| GALFLGWLGAAGSTMGAWSQPKKKRKV | MPS | 152 |
| PVIRRVWFQNKRCKDKK | pIs1 | 153 |

In some examples, the PTDs can be modified by replacement of a lysine or arginine with another basic amino acid, such as replacement of a lysine with an arginine or by replacement of an arginine with a lysine.

E. ASSAYS TO ASSESS AND/OR MONITOR MTSP-1 ACTIVITY ON COMPLEMENT-MEDIATED FUNCTIONS

The modified MTSP-1 polypeptides provided herein exhibit altered specificity and/or selectivity for complement protein C3. Exemplary modified MTSP-1 polypeptides specifically cleave complement protein C3 and thereby alter complement activation. Further, exemplary modified MTSP-1 polypeptides provided herein can have altered, or reduced, specificity and/or selectivity for cleavage of substrates of MTSP-1, such as, for example, proteinase-activated receptor-2 (PAR-2), urokinase-type plasminogen activator (uPA), and/or hepatocyte growth factor (HGF).

Various in vitro and in vivo assays can be used to monitor or screen MTSP-1 polypeptides for their ability to cleave complement protein C3 and for their effects on complement activation and complement-mediated diseases and disorders. Such assays are well known to those of skill in the art. One of skill in the art can test a particular MTSP-1 polypeptide for cleavage of complement protein C3 and/or test to assess any change in the effects of a MTSP-1 on a complement-mediated activity compared to the absence of a protease. Some such assays are exemplified herein.

Exemplary in vitro and in vivo assays are provided herein for comparison of an activity of a modified MTSP-1 polypeptide on the function of complement protein C3. In addition, numerous assays, such as assays for measuring complement activation, are known to one of skill in the art. Assays for activities of complement include, but are not limited to, assays that measure activation products of complement activation, such as for example the C5b-9 MAC complex, and generation of any one or more of the complement cleavage products such as C5a, C3b, and C3d. Assays to measure complement activation also include functional assays that measure the functional activity of specific components of the complement pathways, such as for example hemolytic assays used to measure activation of any one of the classical, lectin or alternative pathways. Assays to assess effects of MTSP-1 polypeptides on complement proteins and/or complement-mediated functions include, but are not limited to, SDS-PAGE analysis followed by Western Blot or Coomassie Brilliant Blue staining, enzyme immunoassays, and hemolytic assays. In one example, in vitro assays can be performed using purified complement protein C3, as exemplified in Example 2. In another example, in vivo assays can be performed by testing the serum of a species, including mammalian or human species, for functional activation of complement, as exemplified in Examples 8 and 10. In another example, in vitro assays can be performed by testing the serum of a species, including mammalian or human species, for functional activation of complement, as exemplified in Examples 4-6. In another example, in vitro assays can be performed using peptide libraries, as exemplified in Examples 5-7. Various disease models known to one of skill in the art can be used to test the efficacy of MTSP-1 polypeptides provided herein on various complement-mediated diseases and disorders.

Also provided herein are exemplary assays for determining the activity of the modified MTSP-1 polypeptides for wild type MTSP-1 activities, such as cleavage of proteinase-activated receptor-2 (PAR-2), urokinase-type plasminogen activator (uPA), and/or hepatocyte growth factor (HGF). Also provided are assays for determining the specificity of the modified MTSP-1 polypeptides for complement protein C3. Exemplary assays are described below.

1. Methods for Assessing MTSP-1 Activity and Specificity for Cleaving Complement Protein C3 to Inactivate it A modified MTSP-1 protease can exhibit alterations in specificity and/or selectivity for inactivating C3, compared to the corresponding full-length wildtype or protease domain or corresponding form of the unmodified MTSP-1 protease (i.e., the MTSP-1 polypeptides of SEQ ID NOs.: 1-4). Modified MTSP-1 proteases provided herein can retain protease activity, but exhibit an increased specificity and/or selectivity or activity for cleaving C3 to thereby inhibit complement activation. All such modified MTSP-1 proteases with increased specificity and/or selectivity to any one or more complement protein are candidate therapeutics for treating any disorder in which complement activation plays a role or is involved.

Where the modified MTSP-1protease exhibits an increased specificity and/or selectivity to any one or more complement protein, in vitro and in vivo assays can be used to monitor or screen proteases for effects on complement-mediated functions. Such assays are well known to those of skill in the art. One of skill in the art can test a modified MTSP-1 protease for cleavage of C3 and/or test to assess any change in the effects of a modified MTSP-1 protease on a complement-mediated activity compared to the absence of a modified MTSP-1 protease. Some such assays are exemplified herein.

Exemplary in vitro and in vivo assays are provided herein for comparison of an activity of a modified MTSP-1 protease on the function of any one or more targeted complement proteins. Many of the assays are applicable to other proteases and modified proteases. In addition, numerous assays, such as assays for measuring complement activation, are known to one of skill in the art. Assays for activities of complement include, but are not limited to, assays that measure activation products of complement activation, such as for example the C5b-9 MAC complex, and generation of any one or more of the complement cleavage products such as C4a, C5a, C3b, and C3d. Assays to measure complement activation also include functional assays that measure the functional activity of specific components of the complement pathways, such as for example hemolytic assays used to measure activation of any one of the classical, lectin or alternative pathways. Assays to assess effects of proteases and modified proteases on complement proteins and/or complement-mediated functions include, but are not limited to, SDS-analysis followed by Western Blot or Coomassie Brilliant Blue staining, enzyme immunoassays, and hemolytic assays. In one example, in vitro assays can be performed using purified complement proteins. In another example, in vivo assays can be performed by testing the serum of a species, including mammalian or human species, for functional activation of complement. Exemplary assays are described below.

a. Protein Detection

Protein detection is a means to measure individual complement components in a sample. Complement proteins can be detected to assess directly the effects of a MTSP-1 polypeptide on cleavage of complement protein C3, or alternatively, complement proteins can be measured as a means to assess complement activation. Complement protein C3, treated in the presence or absence of a MTSP-1 polypeptide, can be analyzed by any one or more assays including SDS-PAGE followed by Coomassie staining or Western Blot, enzyme immunoassay, immunohistochemistry, flow cytometry, nephelometry, agar gel diffusion, or radial immunodiffusion. Exemplary assays for protein detection are described below.

i. SDS-PAGE Analysis

Analysis of complement proteins in the presence or absence of increasing concentrations of MTSP-1 polypeptide can be performed by analysis of proteins on SDS-PAGE followed by detection of those proteins. In such examples, complement proteins can be detected by staining for total protein, such as by Coomassie Brilliant Blue stain, Silver stain, or by any other method known to one of skill in the art, or by Western Blot using polyclonal or monoclonal antibodies specific for a specified protein. Typically, a purified complement protein, such as for example complement protein C3, can be incubated in the presence or absence of a MTSP-1 polypeptide. The treated complement protein can be resolved on an SDS-PAGE gel followed by a method to detect protein in the gel, for example, by staining with Coomassie Brilliant blue. The treated protein can be compared to its cognate full length protein and the degradation products formed by protease cleavage of the protein can be determined.

In another embodiment, a sample, such as for example human serum or plasma or breast milk, can be treated in the presence or absence of a MTSP-1 polypeptide or can be collected after treatment of an animal or a human with or without a MTSP-1 polypeptide. The MTSP-1-treated sample can be analyzed on SDS-PAGE and a specific complement protein can be detected, such as for example C3, C5, or Factor B, by Western Blot using monoclonal or polyclonal antibodies against the protein. The cleavage of the complement protein can be compared to a sample that was not treated with a MTSP-1 polypeptide. Additionally, the sample can be stimulated to initiate complement activation such as by incubation with IgG which stimulates activation of the classical pathway or by LPS which stimulates activation of the alternative pathway. The sample can be resolved by SDS-PAGE for detection of any one or more of the native complement proteins to determine the presence or absence of cleavage products of a specified protein compared to a sample of the protein not treated with a MTSP-1 polypeptide. In such examples, cleavage effector molecules of native complement proteins also can be analyzed by Western Blot using monoclonal and polyclonal antibodies to assess the activation of one or more of the complement pathways. Examples of complement effector molecules can include, but are not limited to, C3a, C3d, iC3b, Bb, and C5-b9. For example, decreased expression in a sample of Bb can indicate that a MTSP-1 polypeptide inhibited the activation of the alternative pathway of complement. The cleavage products of the effector molecules also can be determined to assess the effects of increasing concentrations of a MTSP-1 polypeptide on the cleavage of complement effector molecules themselves.

ii. Enzyme Immunoassay

Enzyme immunoassay (EIA; also called enzyme-linked immunosorbent assay; ELISA) is an assay used to measure the presence of a protein in a sample. Typically, measurement of the protein is an indirect measurement of the binding of the protein to an antibody, which itself is chemically labeled with a detectable substrate such as an enzyme or fluorescent compound. EIA assays can be used to measure the effects of MTSP-1 polypeptides on complement activation by measuring for the presence of a complement effector molecule generated following complement activation. In such examples, a sample, such as for example human serum or plasma, can be pretreated in the presence or absence of increasing concentrations of a MTSP-1 polypeptide and subsequently activated to induce complement activation by incubation with initiating molecules, or can be collected following treatment of an animal or a human with a MTSP-1 polypeptide. For example, the classical pathway can be activated by incubation with IgG and the alternative pathway can be activated by incubation of the sample with LPS. A complement activation assay specific for the lectin pathway requires that the classical pathway of complement is inhibited since the C4/C2 cleaving activity of the lectin pathway is shared with the classical pathway of complement. Inhibition of the classical pathway can be achieved using a high ionic strength buffer which inhibits the binding of C1q to immune complexes and disrupts the C1 complex, whereas a high ionic strength buffer does not affect the carbohydrate binding activity of MBL. Consequently, activation of the lectin pathway can be induced by incubation of a sample, such as human serum or plasma, with a mannan-coated surface in the presence of 1 M NaCl.

Following activation, the sample can be quenched with the addition of

Pefabloc (Roche) and EDTA to minimize continued activation of the pathways. Samples can be analyzed for the presence of complement effector molecules by an EIA or ELISA assay. EIA and ELISA assays for measuring complement proteins are well known to one skilled in the art. Any complement activation product can be assessed. Exemplary complement activation products for measurement of complement activation include iC3b, Bb, C5b-9, C3a, C3a-desArg and C5a-desArg. The complement pathway activated can be determined depending on the complement activation product measured. For example, measurement of Bb cleavage product is a unique marker of the alternative pathway.

In some examples, the EIA can be paired with detection of the cleaved complement proteins by analysis of the protease-treated, complement-stimulated sample by SDS-PAGE followed by Western blot analysis for identification of specific complement components. Using densitometry software, the cleavage of the complement product can be compared to the full length complement component cleaved throughout the assay and the appearance of all major degradation products and the percent cleavage can be determined.

iii. Radial Immunodiffusion (RID)

Radial immunodiffusion (RID) is a technique that relies on the precipitation of immune complexes formed between antibodies incorporated into agarose gels when it is poured, and antigen present in a test sample resulting in a circular precipitin line around the sample well. The diameter of the precipitin ring is proportional to the concentration of the antibody (or antigen) present in the test sample. By comparing the diameter of the test specimen precipitin ring to known standards, a relatively insensitive estimation of the concentration of specific antibody or antigen can be achieved. RID can be used to measure the amount of a complement protein in a sample. For example, a sample such as for example human serum or plasma, can be treated in the presence or absence of increasing concentrations of a MTSP-1 polypeptide. The protease-treated sample can be added to a well of an agarose gel that has been made to incorporate a polyclonal or monoclonal antibody against any one of the complement proteins such as including, but not limited to, C3, C5, C6, C7, C9, or Factor B. After removal of unprecipitated proteins by exposure to 0.15 M NaCl, the precipitated protein rings can be assessed by staining with a protein dye, such as for example Coomassie Brilliant blue or Crowles double stain.

b. Hemolytic Assays

Functional hemolytic assays provide information on complement function as a whole. This type of assay uses antibody-sensitized or unsensitized sheep erythrocytes. Hemolytic assays include the total hemolytic complement assay (CH50), which measures the ability of the classical pathway and the MAC to lyse a sheep RBC. It depends on the sequential activation of the classical pathway components (C1 through C9) to lyse sheep erythrocytes that have been sensitized with optimal amounts of rabbit anti-sheep erythrocyte antibodies to make cellular antigen-antibody complexes. Hemolytic assays also can include an alternative pathway CH50 assay (rabbit CH50 or APCH50), which measures the ability of the alternative pathway and the MAC to lyse a rabbit RBC. One CH50 and/or APCH50 unit is defined as the quantity or dilution of serum required to lyse 50% of the red cells in the test. Typically, to assess complement activation, a sample, such as for example human serum or human plasma, can be treated in the presence or absence of increasing concentrations of a MTSP-1 polypeptide, or can be collected following treatment of an animal or human in the presence or absence of a MTSP-1 polypeptide. The protease-treated sample can be subsequently mixed with sheep's red blood cells that have been activated or sensitized with IgG. A water only sample mixed with sheep red blood cells can act as a total lysis control in order to accurately assess percent lysis of the samples analyzed. The addition of 0.15M NaCl to the sample can be added to stop the lysing reaction. Lysis of the red blood cells, induced by the activation of the terminal components of the complement pathway, can be assessed by measuring the release of hemoglobin. Measurement can be by optical density (OD) readings of the samples using a spectrophotometer at an OD of 415 nm.

In one embodiment, limiting dilution hemolytic assays can be used to measure functional activity of specific components of either pathway. In such an assay, a serum source is used that has an excess of all complement components, but is deficient for the one being measured in the sample, i.e., a media or serum source is complement-depleted for a specific protein. The extent of hemolysis is therefore dependent on the presence of the measured component in the test sample. In such an assay, a purified complement protein, such as for example any one of the native complement proteins including, but not limited to C3, can be incubated in the presence or absence of increasing concentrations of a MTSP-1 polypeptide. The protease-treated purified complement protein can then be mixed with complement-depleted media or plasma and IgG-activated sheep red blood cells and hemolysis of the sample can be assessed as described above. In another embodiment, protease cleavage can be correlated with complement activation by assaying for hemolytic activity of a protease-treated sample, and subsequently analyzing the sample on SDS-PAGE gel followed by staining with a protein stain, such as for example Coomassie Blue. The purified complement protein treated with the proteases can be assessed for cleavage and the percentage of the full length complement component cleaved throughout the assay and the appearance of all major degradation products can be calculated. Alternatively, analysis of the protease-treated complement protein can be by Western blot.

An alternative to the hemolytic assay, called the liposome immunoassay (LIA), can be used to assess activation of the classical pathway. The LIA (Waco Chemicals USA, Richmond, Va.) utilizes dinitrophenyl (DNP)-coated liposomes that contain the enzyme glucose-6-phosphate dehydrogenase. When serum is mixed with the liposomes and a substrate containing anti-DNP antibody, glucose-6-phosphate, and nicotinamide adenine dinucleotide, activated liposomes lyse, and an enzymatic colorimetric reaction occurs which is proportional to total classical complement activity.

c. Methods for Determining Cleavage Sites

Cleavage sequences in complement protein C3 can be identified by any method known in the art (see e.g., published U.S. Publication No. US 2004/0146938). In one example, a cleavage sequence is determined by incubating complement protein C3 with any modified MTSP-1 polypeptide provided herein. Following incubation with the MTSP-1 polypeptide, the C3 protein can be separated by SDS-PAGE and degradative products can be identified by staining with a protein dye such as Coomassie Brilliant Blue. Proteolytic fragments can be sequenced to determine the identity of the cleavage sequences. After identification, fluorogenic peptide substrates designed based on the cleavage sequence of a desired target substrate can be used to assess activity, as described below.

2. Methods for Assessing Wild Type MTSP-1 Activity

The modified MTSP-1 polypeptides provided herein can have altered, or reduced, specificity for their normal substrates, such as, for example, proteinase-activated receptor-2 (PAR-2), urokinase-type plasminogen activator (uPA), and/or hepatocyte growth factor (HGF). Modified MTSP-1 polypeptides can be tested to determine whether they retain catalytic efficiency and/or substrate specificity for their native substrate. For example, cleavage of PAR-2 can be assessed by incubation of a MTSP-1 polypeptide with PAR-2 and detecting protein cleavage products. In another example, cleavage of PAR-2 can be determined in vitro by measuring cleavage of a fluorogenically tagged tetrapeptide of the peptide substrate, for example, a fluorogenic substrate, such as fluorophores ACC (7-amino-4-carbamoyl-methy-coumarin)- or AMC-(7-amino-4-methylcoumarin) linked to a tetrapeptide. In some examples, PAR-2 activation assays are used to determine the specificity of the MTSP-1 polypeptides provided herein.

In another example, cleavage of C3 can be assessed by incubation of a MTSP-1 polypeptide with C3 and detecting protein cleavage products. In another example, cleavage of C3 can be determined in vitro by measuring cleavage of a fluorogenically tagged tetrapeptide of the peptide substrate, for example, an ACC- or AMC-tetrapeptide. In some examples, C3 activation assays are used to determine the specificity of the modified MTSP-1 polypeptides provided herein. In another example, cleavage of HGF can be assessed by incubation of a modified MTSP-1 polypeptide with HGF and detecting protein cleavage products. In another example, cleavage of HGF can be determined in vitro by measuring cleavage of a fluorogenically tagged tetrapeptide of the peptide substrate, for example, an ACC- or AMC-tetrapeptide. In some examples, HGF activation assays are used to determine the specificity of the MTSP-1 polypeptides provided herein. In other examples, the ability of the MTSP-1 polypeptides provided herein to form a complex with the Kunitz-type serine protease inhibitor, hepatocyte growth factor activator inhibitor-1 (HAI-1) is determined.

a. Cleavage of MTSP-1 Substrates

In one example, modified MTSP-1 polypeptides can be assayed using individual fluorogenic peptide substrates corresponding to the desired cleavage sequence. For example, a method of assaying for a modified MTSP-1 protease that can cleave any one or more of the desired cleavage sequences includes: (a) contacting a peptide fluorogenic sample (containing a desired target cleavage sequence) with a protease, in such a manner whereby a fluorogenic moiety is released from a peptide substrate sequence upon action of the protease, thereby producing a fluorescent moiety; and (b) observing whether the sample undergoes a detectable change in fluorescence, the detectable change being an indication of the presence of the enzymatically active protease in the sample. In such an example, the desired cleavage sequence is made into a fluorogenic peptide by methods known in the art. In one embodiment, the individual peptide cleavage sequences can be attached to a fluorogenically tagged substrate, such as for example an ACC or AMC fluorogenic leaving group, and the release of the fluorogenic moiety can be determined as a measure of specificity of a protease for a peptide cleavage sequence. The rate of increase in fluorescence of the target cleavage sequence can be measured such as by using a fluorescence spectrophotometer. The rate of increase in fluorescence can be measured over time. Michaelis-Menton kinetic constants can be determined by the standard kinetic methods. The kinetic constants $k_{cat}$, $K_m$ and $k_{cat}/K_m$ can be calculated by graphing the inverse of the substrate concentration versus the inverse of the velocity of substrate cleavage, and fitting to the Lineweaver-Burk equation ($1/\text{velocity}=(K_m/V_{max})(1/[S])+1/V_{max}$; where $V_{max}=[ET]k_{cat}$). The second order rate constant or specificity constant ($k_{cat}/K_m$) is a measure of how well a substrate is cut by a particular protease. For example, an ACC- or AMC-tetrapeptide such as Ac-CPGR-AMC or can be made and incubated with a modified MTSP-1 polypeptide provided herein and activity of the MTSP-1 polypeptide can be assessed by assaying for release of the fluorogenic moiety. The choice of the tetrapeptide depends on the desired cleavage sequence to by assayed for and can be empirically determined.

In other embodiments, MTSP-1 polypeptides also can be assayed to ascertain that they will cleave the desired sequence when presented in the context of the full-length protein. In one example, a purified target protein, i.e., PAR-2, uPA or HGF, can be incubated in the presence or absence of a selected MTSP-1 polypeptide and the cleavage event can be monitored by SDS-PAGE followed by Coomassie Brilliant Blue staining for protein and analysis of cleavage products using densitometry.

b. MTSP-1-Substrate Binding Assays

Binding of the MTSP-1polypeptides to an MTSP-1 substrate can be assessed by any assay known to one of skill in the art to detect protein-protein binding interactions, including but not limited to solid phase binding assays, ELISA, surface plasmon resonance and FACS. In one example, ELISA can be used. The recombinant substrate protein is immobilized on a microtiter plate and MTSP-1 polypeptide binding is measured by addition of a reagent that specifically binds to MTSP-1, such as, for example, an MTSP-1 binding antibody. In another example, binding can be determined in a cell based assay using a cell line that expresses substrate. The MTSP-1 polypeptides can be labeled, for example, with a chromogenic, fluorogenic or radioactive substrate to effect detection of binding.

c. C3 Cleavage Assays

The activity of the modified MTSP-1 polypeptides can be assessed by cleavage of the substrate complement protein human C3 by measuring the amount of intact human C3 remaining after incubation with various concentrations of the modified MTSP-1 protease. In accord with this assay, signal is generated in the presence of intact human C3, and is lost as the C3 is cleaved.

Purified C3 protein can be incubated with the modified MTSP-1 polypeptides and the residual levels of undigested human C3 can be quantified by any assay known in the art to assess protein concentration, such as, for example using an Amplified Luminescent Proximity Homogeneous Assay Screen (AlphaScreen; Perkin Elmer). The C3/MTSP-1 polypeptide mixture is incubated with α-mouse IgG-coated acceptor beads, and following incubation the α-hC3 mAb/acceptor beads mixture is incubated with a biotinylated α-hC3 pAb. Streptavidin-coated donor beads are added to the mixture and the 'alphascreen' signal (Excitation=680 nm, Emission=570 nm) is then measured. This signal corresponds to the concentration of remaining C3 protein. The concentration of MTSP-1 polypeptide required to cleave through 50% of the available hC3 ($EC_{50}$) can be calculated.

3. Specificity

The specificity constant of cleavage of target substrate, e.g., complement protein C3 or an MTSP-1 substrate, such as, for example, PAR-2, uPA or HGF, by a modified MTSP-1 polypeptide can be determined by using gel densitometry to assess changes in densitometry over time of a full-length target substrate incubated in the presence of a MTSP-1 polypeptide. In specific embodiments, comparison of the specificities of a modified MTSP-1 polypeptide can be used to determine if the modified MTSP-1 polypeptide exhibits altered, for example, increased, specificity for C3 compared to the wild-type or reference MTSP-1 polypeptide. The specificity of a MTSP-1 polypeptide for a target substrate, e.g. complement protein C3, can be determined from the specificity constant of cleavage of a target substrate compared to a non-target substrate (e.g. the native wild type substrate of MTSP-1). A ratio of the specificity constants of a modified MTSP-1 polypeptide for the target substrate C3 versus a non-target substrate, such as, for example, PAR-2, uPA or HGF, can be made to determine a ratio of the efficiency of cleavage of the modified MTSP-1 polypeptide. Comparison of the ratio of the efficiency of cleavage between a modified MTSP-1 polypeptide and a wild-type or reference MTSP-1 polypeptide can be used to assess the fold change in specificity for a target substrate. Specificity can be at least 2-fold, at least 4-fold, at least 5-fold, at least 6-fold, at least 7-fold, 8, 9, 10, 20, 30, 40, 50, 60, 70, 80, 90, 100, 200, 300, 400, 500, 600, 700, 800, 900, or 1000 times or more when compared to the specificity of a wild-type MTSP-1 polypeptide for a target substrate versus a non-target substrate.

Kinetic analysis of cleavage of native substrates of a MTSP-1 polypeptide can be compared to analysis of cleavage of desired target substrates in complement protein C3 to assess specificity of the modified MTSP-1 polypeptide for complement protein C3. In addition, second order rate constants of inhibition (ki) can be assessed to monitor the efficiency and reactivity of a modified MTSP-1 polypeptide for complement protein C3. For purposes herein, the modified MTSP-1 polypeptides cleave C3 so that complement activation is inhibited, and, as shown in the Examples, they do so with significantly greater activity, such as at least 5-fold more activity, than unmodified modified MTSP-1 polypeptide (or modified MTSP-1 polypeptide with the C122S replacement, which eliminates a free cysteine to thereby reduce aggregation. For example, the modified MTSP-1 polypeptide of SEQ ID NO:35, cleaves human C3 in the assay described herein with a an $ED_{50}$ of 2 nM, compared to 11 nM for the wild-type protease domain of SEQ ID NO:4.

4. Disease Models

The modified MTSP-1 polypeptides provided herein can be used in any clinically relevant disease model known to one of skill in the art to determine their effects on complement-mediated diseases or disorders. Exemplary assays include, but are not limited to, assays for transplantation, including in vitro assays with human islet cells (Tjernberg et al. (2008) *Transplantation* 85:1193-1199) and ex vivo assays with pig kidneys (Fiane et al. (1999) *Xenotransplantation* 6:52-65); bioincompatibility, including in vitro artificial surface-induced inflammation (Lappegard et al. (2008) *J Biomed Mater Res A* 87:129-135; Lappegard et al. (2005) *Ann Thorac Surg* 79:917-923; Nilsson et al. (1998) *Blood* 92:1661-1667; Schmidt et al. (2003) *J Biomed Mater Res A* 66:491-499); inflammation, including in vitro *E. coli*-induced inflammation (Mollnes et al. (2002) *Blood* 100:1867-1877) and heparin/protamine complex-induced inflammation in baboons (Soulika et al. (2000) *Clin Immunol* 96:212-221); age-related macular degeneration in rabbits and monkeys and rodents (Chi et al. (2010) *Adv Exp Med Biol* 703:127-135; Pennesi et al. (2012) *Mol. Aspects Med.* 33(4): 487-509; Fletcher et al. (2014) *Optm. Vis. Sci.* 91(8):878-886; Forest et al. (2015) *Disease Models and Mechanisms* 8:421-427); and delayed graft function in pigs (Hanto et al., (2010) *Am J Transplant* 10(11):2421-2430) and dogs (Petrinec et al. (1996) *Surgery* 61:1331-1337).

F. METHODS OF PRODUCING NUCLEIC ACIDS ENCODING MODIFIED MTSP-1 POLYPEPTIDES

Polypeptides of a modified MTSP-1 polypeptide set forth herein can be obtained by methods well known in the art for protein purification and recombinant protein expression. Polypeptides also can be synthesized chemically. Modified or variant, including truncated forms, can be engineered from a wild type polypeptide using standard recombinant DNA methods. For example, modified MTSP-1 polypeptides can be engineered from a wild type polypeptide, such as by site-directed mutagenesis.

1. Isolation or Preparation of Nucleic Acids Encoding MTSP-1 Polypeptides

Polypeptides can be cloned or isolated using any available methods known in the art for cloning and isolating nucleic acid molecules. Such methods include PCR amplification of nucleic acids and screening of libraries, including nucleic acid hybridization screening, antibody-based screening and activity-based screening. For example, when the polypeptides are produced by recombinant means, any method known to those of skill in the art for identification of nucleic acids that encode desired genes can be used. Any method available in the art can be used to obtain a full length or partial (i.e., encompassing the entire coding region) cDNA or genomic DNA clone encoding a MTSP-1, such as from a cell or tissue source.

Methods for amplification of nucleic acids can be used to isolate nucleic acid molecules encoding a desired polypeptide, including for example, polymerase chain reaction (PCR) methods. Exemplary of such methods include use of a Perkin-Elmer Cetus thermal cycler and Taq polymerase (Gene Amp). A nucleic acid containing material can be used as a starting material from which a desired polypeptide-encoding nucleic acid molecule can be isolated. For example, DNA and mRNA preparations, cell extracts, tissue extracts, fluid samples (e.g., blood, serum, saliva, breast milk), samples from healthy and/or diseased subjects can be used in amplification methods. The source can be from any eukaryotic species including, but not limited to, vertebrate, mammalian, human, porcine, bovine, feline, avian, equine, canine, and other primate sources. Nucleic acid libraries also can be used as a source of starting material. Primers can be designed to amplify a desired polypeptide. For example, primers can be designed based on expressed sequences from which a desired polypeptide is generated. Primers can be designed based on back-translation of a polypeptide amino acid sequence. If desired, degenerate primers can be used for amplification. Oligonucleotide primers that hybridize to sequences at the 3' and 5' termini of the desired sequence can be uses as primers to amplify by PCR sequences from a nucleic acid sample. Primers can be used to amplify the entire full-length MTSP-1, or a truncated sequence thereof, such as a nucleic acid encoding any of the soluble MTSP-1 polypeptides provided herein. Nucleic acid molecules generated by amplification can be sequenced and confirmed to encode a desired polypeptide.

Additional nucleotide sequences can be joined to a polypeptide-encoding nucleic acid molecule, including linker sequences containing restriction endonuclease sites for the purpose of cloning the synthetic gene into a vector, for example, a protein expression vector or a vector designed for the amplification of the core protein coding DNA sequences. Furthermore, additional nucleotide sequences specifying functional DNA elements can be operatively linked to a polypeptide-encoding nucleic acid molecule. Examples of such sequences include, but are not limited to, promoter sequences designed to facilitate intracellular protein expression, and secretion sequences, for example heterologous signal sequences, designed to facilitate protein secretion. Such sequences are known to those of skill in the art. Additional nucleotide residues sequences such as sequences of bases specifying protein binding regions also can be linked to enzyme-encoding nucleic acid molecules. Such regions include, but are not limited to, sequences of residues that facilitate or encode proteins that facilitate uptake of an enzyme into specific target cells, or otherwise alter pharmacokinetics of a product of a synthetic gene.

In addition, tags or other moieties can be added, for example, to aid in detection or affinity purification of the polypeptide. For example, additional nucleotide residues sequences such as sequences of bases specifying an epitope tag or other detectable marker also can be linked to enzyme-encoding nucleic acid molecules. Exemplary of such sequences include nucleic acid sequences encoding a SUMO tag or His tag or Flag Tag.

The identified and isolated nucleic acids can then be inserted into an appropriate cloning vector. A large number of vector-host systems known in the art can be used. Possible vectors include, but are not limited to, plasmids or modified viruses, but the vector system must be compatible with the host cell used. Such vectors include, but are not limited to, bacteriophages such as lambda derivatives, or plasmids such as pCMV4, pBR322 or pUC plasmid derivatives or the Bluescript vector (Stratagene, La Jolla, Calif.). The insertion into a cloning vector can, for example, be accomplished by ligating the DNA fragment into a cloning vector which has complementary cohesive termini. Insertion can be effected using TOPO cloning vectors (Invitrogen, Carlsbad, Calif.).

If the complementary restriction sites used to fragment the DNA are not present in the cloning vector, the ends of the DNA molecules can be enzymatically modified. Alternatively, any site desired can be produced by ligating nucleotide sequences (linkers) onto the DNA termini; these ligated linkers can contain specific chemically synthesized oligonucleotides encoding restriction endonuclease recognition sequences. In an alternative method, the cleaved vector and protein gene can be modified by homopolymeric tailing.

Recombinant molecules can be introduced into host cells via, for example, transformation, transfection, infection, electroporation and sonoporation, so that many copies of the gene sequence are generated. In specific embodiments, transformation of host cells with recombinant DNA molecules that incorporate the isolated protein gene, cDNA, or synthesized DNA sequence enables generation of multiple copies of the gene. Thus, the gene can be obtained in large quantities by growing transformants, isolating the recombinant DNA molecules from the transformants and, when necessary, retrieving the inserted gene from the isolated recombinant DNA.

In addition to recombinant production, modified MTSP-1 polypeptides provided herein, can be produced by direct peptide synthesis using solid-phase techniques (see e.g., Stewart et al. (1969) Solid-Phase Peptide Synthesis, WH Freeman Co., San Francisco; Merrifield J (1963) *J Am Chem Soc.*, 85:2149-2154). In vitro protein synthesis can be performed using manual techniques or by automation. Automated synthesis can be achieved, for example, using Applied Biosystems 431A Peptide Synthesizer (Perkin Elmer, Foster City Calif.) in accordance with the instructions provided by the manufacturer. Various fragments of a polypeptide can be chemically synthesized separately and combined using chemical methods.

2. Generation of Mutant or Modified Nucleic Acids and Encoding Polypeptides

The modifications provided herein can be made by standard recombinant DNA techniques such as are routine to one of skill in the art. Any method known in the art to effect mutation of any one or more amino acids in a target protein can be employed. Methods include standard site-directed mutagenesis (using e.g., a kit, such as QuikChange available from Stratagene) of encoding nucleic acid molecules, or by solid phase polypeptide synthesis methods.

3. Vectors and Cells

For recombinant expression of one or more of the desired proteins, such as any modified MTSP-1 polypeptide described herein, the nucleic acid containing all or a portion of the nucleotide sequence encoding the protein can be inserted into an appropriate expression vector, i.e., a vector that contains the necessary elements for the transcription and translation of the inserted protein coding sequence. The necessary transcriptional and translational signals also can be supplied by the native promoter for enzyme genes, and/or their flanking regions.

Also provided are vectors that contain a nucleic acid encoding the enzyme. Cells containing the vectors also are provided. The cells include eukaryotic and prokaryotic cells, and the vectors are any suitable for use therein. Generally, the cell is a cell that is capable of effecting glycosylation of the encoded protein.

Prokaryotic and eukaryotic cells containing the vectors are provided. Such cells include bacterial cells, yeast cells, fungal cells, Archea, plant cells, insect cells and animal cells. The cells are used to produce a protein thereof by growing the above-described cells under conditions whereby the encoded protein is expressed by the cell, and recovering the expressed protein. For purposes herein, for example, the enzyme can be secreted into the medium.

A host cell strain can be chosen for its ability to modulate the expression of the inserted sequences or to process the expressed protein in the desired fashion. Such modifications of the polypeptide include, but are not limited to, acetylation, carboxylation, glycosylation, phosphorylation, lipidation and acylation. Post-translational processing can impact the folding and/or function of the polypeptide. Different host cells, such as, but not limited to, CHO (DG44, DXB11, CHO-K1), HeLa, MCDK, 293 and WI38 have specific cellular machinery and characteristic mechanisms for such post-translational activities and can be chosen to ensure the correct modification and processing of the introduced protein. Generally, the choice of cell is one that is capable of introducing N-linked glycosylation into the expressed polypeptide. Hence, eukaryotic cells containing the vectors are provided. Exemplary of eukaryotic cells are mammalian Chinese Hamster Ovary (CHO) cells. For example, CHO cells deficient in dihydrofolate reductase (e.g., DG44 cells) are used to produce polypeptides provided herein.

Provided are vectors that contain a sequence of nucleotides that encodes the modified MTSP-1 polypeptide, such as the modified MTSP-1 protease domain, coupled to the native or heterologous signal sequence, as well as multiple copies thereof. The vectors can be selected for expression of the enzyme protein in the cell or such that the enzyme protein is expressed as a secreted protein.

In one embodiment, vectors containing a sequence of nucleotides that encodes a polypeptide that has protease activity and contains all or a portion of the protease domain, or multiple copies thereof, are provided. Also provided are vectors that contain a sequence of nucleotides that encodes the protease domain and additional portions of a protease protein up to and including a full length protease protein, as well as multiple copies thereof. The vectors can be selected for expression of the scaffold or modified protease protein or protease domain thereof in the cell or such that the protease protein is expressed as a secreted protein. When the protease domain is expressed the nucleic acid is linked to nucleic acid encoding a secretion signal, such as the *Saccharomyces cerevisiae* α-mating factor signal sequence or a portion thereof, or the native signal sequence.

A variety of host-vector systems can be used to express the protein coding sequence. These include but are not limited to mammalian cell systems infected with virus (e.g., vaccinia virus, adenovirus and other viruses); insect cell systems infected with virus (e.g., baculovirus); microorganisms such as yeast containing yeast vectors; or bacteria transformed with bacteriophage, DNA, plasmid DNA, or cosmid DNA. The expression elements of vectors vary in their strengths and specificities. Depending on the host-vector system used, any one of a number of suitable transcription and translation elements can be used.

Any methods known to those of skill in the art for the insertion of DNA fragments into a vector can be used to construct expression vectors containing a chimeric gene containing appropriate transcriptional/translational control signals and protein coding sequences. These methods can include in vitro recombinant DNA and synthetic techniques and in vivo recombinants (genetic recombination). Expression of nucleic acid sequences encoding protein, or domains, derivatives, fragments or homologs thereof, can be regulated by a second nucleic acid sequence so that the genes or fragments thereof are expressed in a host transformed with the recombinant DNA molecule(s). For example, expression of the proteins can be controlled by any promoter/enhancer known in the art. In a specific embodiment, the promoter is not native to the genes for a desired protein. Promoters which can be used include but are not limited to the SV40 early promoter (Benoist and Chambon (1981) *Nature* 290: 304-310), the promoter contained in the 3' long terminal repeat of Rous sarcoma virus (Yamamoto et al. (1980) *Cell* 22:787-797), the herpes thymidine kinase promoter (Wagner et al. (1981) *Proc. Natl. Acad. Sci. USA* 78:1441-1445), the regulatory sequences of the metallothionein gene (Brinster et al. (1982) *Nature* 296:39-42); prokaryotic expression vectors such as the β-lactamase promoter (Jay et al., (1981) *Proc. Natl. Acad. Sci. USA* 78:5543) or the tac promoter (DeBoer et al. (1983) *Proc. Natl. Acad. Sci. USA* 80:21-25); see also "Useful Proteins from Recombinant Bacteria": in Scientific American 242:79-94 (1980); plant expression vectors containing the nopaline synthetase promoter (Herrara-Estrella et al. (1984) *Nature* 303:209-213) or the cauliflower mosaic virus 35S RNA promoter (Garder et al. (1981) *Nucleic Acids Res.* 9:2871), and the promoter of the photosynthetic enzyme ribulose bisphosphate carboxylase (Herrera-Estrella et al. (1984) *Nature* 310:115-120); promoter elements from yeast and other fungi such as the Gal4 promoter, the alcohol dehydrogenase promoter, the phosphoglycerol kinase promoter, the alkaline phosphatase promoter, and the following animal transcriptional control regions that exhibit tissue specificity and have been used in transgenic animals: elastase I gene control region which is active in pancreatic acinar cells (Swift et al. (1984) *Cell* 38:639-646; Ornitz et al. (1986) *Cold Spring Harbor Symp. Quant. Biol.* 50:399-409; MacDonald (1987) *Hepatology* 7:425-515); insulin gene control region which is active in pancreatic beta cells (Hanahan et al. (1985) *Nature* 315:115-122), immunoglobulin gene control region which is active in lymphoid cells (Grosschedl et al. (1984) *Cell* 38:647-658; Adams et al. (1985) *Nature* 318:533-538; Alexander et al. (1987) *Mol. Cell Biol.* 7:1436-1444), mouse mammary tumor virus control region which is active in testicular, breast, lymphoid and mast cells (Leder et al. (1986) *Cell* 45:485-495), albumin gene control region which is active in liver (Pinckert et al. (1987) *Genes and Devel.* 1:268-276), alpha-fetoprotein gene control region which is active in liver (Krumlauf et al. (1985) *Mol. Cell. Biol.* 5:1639-1648; Hammer et al. (1987) *Science* 235:53-58), alpha-1 antitrypsin gene control region which is active in liver (Kelsey et al. (1987) *Genes and Devel.* 1:161-171), beta globin gene control region which is active in myeloid cells (Magram et al., (1985) *Nature* 315:338-340; Kollias et al. (1986) *Cell* 46:89-94), myelin basic protein gene control region which is active in oligodendrocyte cells of the brain (Readhead et al. (1987) *Cell* 48:703-712), myosin light chain-2 gene control region which is active in skeletal muscle (Shani (1985), *Nature* 314:283-286), and gonadotrophic releasing hormone gene control region which is active in gonadotrophs of the hypothalamus (Mason et al. (1986) *Science* 234:1372-1378).

In a specific embodiment, a vector is used that contains a promoter operably linked to nucleic acids encoding a desired protein, or a domain, fragment, derivative or homolog, thereof, one or more origins of replication, and optionally, one or more selectable markers (e.g., an antibiotic resistance gene). Depending on the expression system, specific initiation signals also are required for efficient translation of a MTSP-1 sequence. These signals include the ATG initiation codon and adjacent sequences. In cases where the initiation codon and upstream sequences of MTSP-1 or catalytically active fragments thereof are inserted into the appropriate expression vector, no additional translational control signals are needed. In cases where only coding sequence, or a portion thereof, is inserted, exogenous transcriptional control signals including the ATG initiation codon must be provided. Furthermore, the initiation codon must be in the correct reading frame to ensure transcription of the entire insert. Exogenous transcriptional elements and initiation codons can be of various origins, both natural and synthetic. The efficiency of expression can be enhanced by the inclusion of enhancers appropriate to the cell system in use (Scharf et al. (1994) *Results Probl Cell Differ* 20:-62; Bittner et al. (1987) *Methods in Enzymol* 153:516-544).

Exemplary plasmid vectors for transformation of *E. coli* cells, include, for example, the pQE expression vectors (available from Qiagen, Valencia, Calif.; see also literature published by Qiagen describing the system). pQE vectors have a phage T5 promoter (recognized by *E. coli* RNA polymerase) and a double lac operator repression module to provide tightly regulated, high-level expression of recombinant proteins in *E. coli*, a synthetic ribosomal binding site (RBS II) for efficient translation, a 6×His tag coding sequence, $t_0$ and T1 transcriptional terminators, ColE1 origin of replication, and a beta-lactamase gene for conferring ampicillin resistance. The pQE vectors enable placement of a 6×His tag at either the N- or C-terminus of the recombinant protein. Such plasmids include pQE 32, pQE 30, and pQE 31 which provide multiple cloning sites for all three reading frames and provide for the expression of N-terminally 6×His-tagged proteins. Other exemplary plasmid vectors for transformation of *E. coli* cells, include, for example, the pET expression vectors (see, U.S. Pat. No. 4,952,496; available from Novagen, Madison, Wis.; see, also literature published by Novagen describing the system). Such plasmids include pET 11a, which contains the T7lac promoter, T7 terminator, the inducible *E. coli* lac operator, and the lac repressor gene; pET 12a-c, which contains the T7 promoter, T7 terminator, and the *E. coli* ompT secretion signal; and pET 15b and pET19b (Novagen, Madison, Wis.), which contain a His-Tag™ leader sequence for use in purification with a His column and a thrombin cleavage site that permits cleavage following purification over the column, the T7-lac promoter region and the T7 terminator.

Typically, vectors can be plasmid, viral, or others known in the art, used for expression of the modified MTSP-1 polypeptide in vivo or in vitro. For example, the modified MTSP-1 polypeptide is expressed in mammalian cells, including, for example, Chinese Hamster Ovary (CHO) cells.

Viral vectors, such as adenovirus, retrovirus or vaccinia virus vectors, can be employed. In some examples, the vector is a defective or attenuated retroviral or other viral vector (see U.S. Pat. No. 4,980,286). For example, a retroviral vector can be used (see, Miller et al. (1993) *Meth. Enzymol.* 217: 581-599). These retroviral vectors have been modified to delete retroviral sequences that are not necessary for packaging of the viral genome and integration into host cell DNA. In some examples, viruses armed with a nucleic acid encoding a modified MTSP-1 polypeptide can facilitate their replication and spread within a target tissue. The virus can also be a lytic virus or a non-lytic virus wherein the virus selectively replicates under a tissue specific promoter. As the viruses replicate, the coexpression of the MTSP-1 polypeptide with viral genes will facilitate the spread of the virus in vivo.

4. Expression

Modified MTSP-1 polypeptides can be produced by any method known to those of skill in the art including in vivo and in vitro methods. The modified MTSP-1 polypeptides can be expressed in any organism suitable to produce the required amounts and forms of the proteins, such as for example, needed for administration and treatment. Expression hosts include prokaryotic and eukaryotic organisms such as *E. coli*, yeast, plants, insect cells, mammalian cells, including human cell lines and transgenic animals. Expression hosts can differ in their protein production levels as well as the types of post-translational modifications that are present on the expressed proteins. The choice of expression host can be made based on these and other factors, such as regulatory and safety considerations, production costs and the need and methods for purification. The skilled person is well-equipped to select appropriate hosts and vectors.

Many expression vectors are available and known to those of skill in the art and can be used for expression of proteins. The choice of expression vector will be influenced by the choice of host expression system. In general, expression vectors can include transcriptional promoters and optionally enhancers, translational signals, and transcriptional and translational termination signals. Expression vectors that are used for stable transformation typically have a selectable marker which allows selection and maintenance of the transformed cells. In some cases, an origin of replication can be used to amplify the copy number of the vector.

Modified MTSP-1 polypeptides also can be utilized or expressed as protein fusions. For example, an enzyme fusion can be generated to add additional functionality to an enzyme. Examples of enzyme fusion proteins include, but are not limited to, fusions of a signal sequence, a tag such as for localization, e.g., a $his_6$ tag or a myc tag, or a tag for purification, for example, a GST fusion, and a sequence for directing protein secretion and/or membrane association.

For example, a modified MTSP-1 polypeptide described herein is one that is generated by expression of a nucleic acid molecule encoding the protease domain set forth in any one of SEQ ID NOS: 1-4, 11-13 and 21-59 or a sequence of amino acids that exhibits at least 65%, 70%, 75%, 80%, 84%, 90%, 91%, 92%, 93%, 94%, 95%, 96%, 97%, 98%, or 99% sequence identity to a sequence set forth in any of SEQ ID NOS: 1-4, 11-13 and 21-59.

For long-term, high-yield production of recombinant proteins, stable expression is desired. For example, cell lines that stably express a modified MTSP-1 polypeptide can be transformed using expression vectors that contain viral origins of replication or endogenous expression elements and a selectable marker gene. Following the introduction of the vector, cells can be allowed to grow for 1-2 days in an enriched media before they are switched to selective media. The purpose of the selectable marker is to confer resistance to selection, and its presence allows growth and recovery of cells that successfully express the introduced sequences. Resistant cells of stably transformed cells can be proliferated using tissue culture techniques appropriate to the cell types.

Any number of selection systems can be used to recover transformed cell lines. These include, but are not limited to, the herpes simplex virus thymidine kinase (Wigler et al., (1977) *Cell* 11:223-232) and adenine phosphoribosyltransferase (Lowy I et al. (1980) *Cell* 22:817-23) genes, which can be employed in TK– or APRT– cells, respectively. Also, antimetabolite, antibiotic or herbicide resistance can be used as the basis for selection. For example, DHFR, which confers resistance to methotrexate (Wigler M et al. (1980) *Proc. Natl. Acad. Sci*, 77:3567-70); npt, which confers resistance to the aminoglycosides neomycin and G-418 (Colbere-Garapin F et al. (1981) *J. Mol. Biol.*, 150:1-14); and als or pat, which confer resistance to chlorsulfuron and phosphinotricin acetyltransferase, respectively, can be used. Additional selectable genes have been described, for example, trpB, which allows cells to utilize indole in place of tryptophan or hisD, which allows cells to utilize histinol in place of histidine (Hartman S C and R C Mulligan (1988) *Proc. Natl. Acad. Sci*, 85:8047-8051). Visible markers, such as but not limited to, anthocyanins, beta glucuronidase and its substrate, GUS, and luciferase and its substrate luciferin, also can be used to identify transformants and also to quantify the amount of transient or stable protein expression attributable to a particular vector system (Rhodes C A et al. (1995) *Methods Mol. Biol.* 55:121-131).

The presence and expression of MTSP-1 polypeptides can be monitored. For example, detection of a functional polypeptide can be determined by testing the conditioned media for hyaluronidase enzyme activity under appropriate conditions. Exemplary assays to assess the solubility and activity of expressed proteins is provided herein.

a. Prokaryotic Cells

Prokaryotes, especially *E. coli*, provide a system for producing large amounts of proteins. Transformation of *E. coli* is a simple and rapid technique well known to those of skill in the art. Expression vectors for *E. coli* can contain inducible promoters, such promoters are useful for inducing high levels of protein expression and for expressing proteins that exhibit some toxicity to the host cells. Examples of inducible promoters include the lac promoter, the trp promoter, the hybrid tac promoter, the T7 and SP6 RNA promoters and the temperature regulated λPL promoter.

Proteins, such as any provided herein, can be expressed in the cytoplasmic environment of *E. coli*. The cytoplasm is a reducing environment and for some molecules, this can result in the formation of insoluble inclusion bodies. Reducing agents such as dithiothreotol and β-mercaptoethanol and denaturants, such as guanidine-HCl and urea can be used to resolubilize the proteins. An alternative approach is the expression of proteins in the periplasmic space of bacteria which provides an oxidizing environment and chaperonin-like and disulfide isomerases and can lead to the production of soluble protein. Typically, a leader sequence is fused to the protein to be expressed which directs the protein to the periplasm. The leader is then removed by signal peptidases inside the periplasm. Examples of periplasmic-targeting leader sequences include the pelB leader from the pectate lyase gene and the leader derived from the alkaline phosphatase gene. In some cases, periplasmic expression allows leakage of the expressed protein into the culture medium. The secretion of proteins allows quick and simple purification from the culture supernatant. Proteins that are not secreted can be obtained from the periplasm by osmotic lysis. Similar to cytoplasmic expression, in some cases proteins can become insoluble and denaturants and reducing agents can be used to facilitate solubilization and refolding. Temperature of induction and growth also can influence expression levels and solubility, typically temperatures between 25° C. and 37° C. are used. Typically, bacteria produce aglycosylated proteins. Thus, if proteins require glycosylation for function, glycosylation can be added in vitro after purification from host cells.

b. Yeast Cells

Yeasts such as *Saccharomyces cerevisae, Schizosaccharomyces pombe, Yarrowia lipolytica, Kluyveromyces lactis* and *Pichia pastoris* are well known yeast expression hosts that can be used for production of proteins, such as any described herein. Yeast can be transformed with episomal replicating vectors or by stable chromosomal integration by homologous recombination. Typically, inducible promoters are used to regulate gene expression. Examples of such promoters include GAL1, GAL7 and GAL5 and metallothionein promoters, such as CUP1, AOX1 or other *Pichia* or other yeast promoter. Expression vectors often include a selectable marker such as LEU2, TRP1, HIS3 and URA3 for selection and maintenance of the transformed DNA. Proteins expressed in yeast are often soluble. Co-expression with chaperonins such as BiP and protein disulfide isomerase can improve expression levels and solubility. Additionally, proteins expressed in yeast can be directed for secretion using secretion signal peptide fusions such as the yeast mating type alpha-factor secretion signal from *Saccharomyces cerevisae* and fusions with yeast cell surface proteins such as the Aga2p mating adhesion receptor or the *Arxula adeninivorans* glucoamylase. A protease cleavage site such as for the Kex-2 protease, can be engineered to remove the fused sequences from the expressed polypeptides as they exit the secretion pathway. Yeast also is capable of glycosylation at Asn-X-Ser/Thr motifs.

c. Insects and Insect Cells

Insect cells, particularly using baculovirus expression, are useful for expressing polypeptides such as MTSP-1 polypeptides. Insect cells express high levels of protein and are capable of most of the post-translational modifications used by higher eukaryotes. Baculovirus have a restrictive host range which improves the safety and reduces regulatory concerns of eukaryotic expression. Typical expression vectors use a promoter for high level expression such as the polyhedrin promoter of baculovirus. Commonly used baculovirus systems include the baculoviruses such as *Autographa californica* nuclear polyhedrosis virus (AcNPV), and the *Bombyx mori* nuclear polyhedrosis virus (BmNPV) and an insect cell line such as Sf9 derived from *Spodoptera frugiperda, Pseudaletia unipuncta* (A7S) and *Danaus plexippus* (DpN1). For high-level expression, the nucleotide sequence of the molecule to be expressed is fused immediately downstream of the polyhedrin initiation codon of the virus. Mammalian secretion signals are accurately processed in insect cells and can be used to secrete the expressed protein into the culture medium. In addition, the cell lines *Pseudaletia unipuncta* (A7S) and *Danaus plexippus* (DpN1) produce proteins with glycosylation patterns similar to mammalian cell systems. Exemplary insect cells are those that have been altered to reduce immunogenicity, including those with "mammalianized" baculovirus expression vectors and those lacking the enzyme FT3.

An alternative expression system in insect cells is the use of stably transformed cells. Cell lines such as the Schnieder 2 (S2) and Kc cells (*Drosophila melanogaster*) and C7 cells (*Aedes albopictus*) can be used for expression. The *Drosophila* metallothionein promoter can be used to induce high levels of expression in the presence of heavy metal induction with cadmium or copper. Expression vectors are typically maintained by the use of selectable markers such as neomycin and hygromycin.

d. Mammalian Expression

Mammalian expression systems can be used to express proteins including MTSP-1 polypeptides. Expression constructs can be transferred to mammalian cells by viral infection such as adenovirus or by direct DNA transfer such as liposomes, calcium phosphate, DEAE-dextran and by physical means such as electroporation and microinjection. Expression vectors for mammalian cells typically include an mRNA cap site, a TATA box, a translational initiation sequence (Kozak consensus sequence) and polyadenylation elements. IRES elements also can be added to permit bicistronic expression with another gene, such as a selectable marker. Such vectors often include transcriptional promoter-enhancers for high-level expression, for example the SV40 promoter-enhancer, the human cytomegalovirus (CMV) promoter and the long terminal repeat of Rous sarcoma virus (RSV). These promoter-enhancers are active in many cell types. Tissue and cell-type promoters and enhancer regions also can be used for expression. Exemplary promoter/enhancer regions include, but are not limited to, those from genes such as elastase I, insulin, immunoglobulin, mouse mammary tumor virus, albumin, alpha fetoprotein, alpha 1 antitrypsin, beta globin, myelin basic protein, myosin light chain 2, and gonadotropic releasing hormone gene control. Selectable markers can be used to select for and maintain cells with the expression construct. Examples of selectable marker genes include, but are not limited to, hygromycin B phosphotransferase, adenosine deaminase, xanthine-guanine phosphoribosyl transferase, aminoglycoside phosphotransferase, dihydrofolate reductase (DHFR) and thymidine kinase. For example, expression can be performed in the presence of methotrexate to select for only those cells expressing the DHFR gene. Fusion with cell surface signaling molecules such as TCR-ζ and $Fc_\epsilon RI$-γ can direct expression of the proteins in an active state on the cell surface.

Many cell lines are available for mammalian expression including mouse, rat human, monkey, chicken and hamster cells. Exemplary cell lines include but are not limited to CHO, Balb/3T3, HeLa, MT2, mouse NS0 (nonsecreting) and other myeloma cell lines, hybridoma and heterohybridoma cell lines, lymphocytes, fibroblasts, Sp2/0, COS, NIH3T3, HEK293, 293S, 2B8, and HKB cells. Cell lines also are available adapted to serum-free media which facilitates purification of secreted proteins from the cell culture media. Examples include CHO-S cells (Invitrogen, Carlsbad, Calif., Catalog number 11619-012) and the serum free EBNA-1 cell line (Pham et al. (2003) *Biotechnol. Bioeng.* 84:332-42.). Cell lines also are available that are adapted to grow in special mediums optimized for maximal expression. For example, DG44 CHO cells are adapted to grow in suspension culture in a chemically defined, animal product-free medium.

e. Plants

Transgenic plant cells and plants can be used to express proteins such as any described herein. Expression constructs are typically transferred to plants using direct DNA transfer such as microprojectile bombardment and PEG-mediated transfer into protoplasts, and with *agrobacterium*-mediated transformation. Expression vectors can include promoter and enhancer sequences, transcriptional termination elements and translational control elements. Expression vectors and transformation techniques are usually divided between dicot hosts, such as *Arabidopsis* and tobacco, and monocot hosts, such as corn and rice. Examples of plant promoters used for expression include the cauliflower mosaic virus promoter, the nopaline synthase promoter, the ribose bisphosphate carboxylase promoter and the ubiquitin and UBQ3 promoters. Selectable markers such as hygromycin, phosphomannose isomerase and neomycin phosphotransferase are often used to facilitate selection and maintenance of transformed cells. Transformed plant cells can be maintained in culture as cells, aggregates (callus tissue) or regenerated into whole plants. Transgenic plant cells also can include algae engineered to produce hyaluronidase polypeptides. Because plants have different glycosylation patterns than mammalian cells, this can influence the choice of protein produced in these hosts.

5. Purification

Host cells transformed with a nucleic acid sequence encoding a modified MTSP-1 polypeptide can be cultured under conditions suitable for the expression and recovery of the encoded protein from cell culture. The protein produced by a recombinant cell generally is designed so that it is secreted, but it can be contained intracellularly depending on the sequence and/or the vector used. As will be understood by those of skill in the art, expression vectors containing nucleic acid encoding MTSP-1 can be designed with signal sequences that facilitate direct secretion of MTSP-1 through prokaryotic or eukaryotic cell membrane.

Thus, method for purification of polypeptides from host cells depend on the chosen host cells and expression systems. For secreted molecules, proteins are generally purified from the culture media after removing the cells. For intracellular expression, cells can be lysed and the proteins purified from the extract. When transgenic organisms such as transgenic plants and animals are used for expression, tissues or organs can be used as starting material to make a lysed cell extract. Additionally, transgenic animal production can include the production of polypeptides in milk or eggs, which can be collected, and if necessary, the proteins can be extracted and further purified using standard methods in the art.

Proteins, such as modified MTSP-1 polypeptides, can be purified using standard protein purification techniques known in the art including but not limited to, SDS-PAGE, size fractionation and size exclusion chromatography, ammonium sulfate precipitation and ionic exchange chromatography, such as anion exchange. Affinity purification techniques also can be utilized to improve the efficiency and purity of the preparations. For example, antibodies, receptors and other molecules that bind MTSP-1 proteins can be used in affinity purification.

Expression constructs also can be engineered to add an affinity tag to a protein such as a Small Ubiquitin-like Modifier (SUMO) tag, myc epitope, GST fusion or $His_6$ and affinity purified with SUMO or myc antibody, glutathione resin and Ni-resin, respectively. Such tags can be joined to the nucleotide sequence encoding a MTSP-1 as described elsewhere herein, which can facilitate purification of soluble proteins. For example, a modified MTSP-1 polypeptide can be expressed as a recombinant protein with one or more additional polypeptide domains added to facilitate protein purification. Such purification facilitating domains include, but are not limited to, metal chelating peptides such as histidine-tryptophan modules that allow purification on immobilized metals, protein A domains that allow purification on immobilized immunoglobulin and the domain utilized in the FLAGS extension/affinity purification system (Immunex Corp., Seattle Wash.). The inclusion of a cleavable linker sequence such as Factor XA or enterokinase (Invitrogen, San Diego, Calif.) between the purification domain and the expressed MTSP-1 polypeptide is useful to facilitate purification. One such expression vector provides for expression of a fusion protein containing a MTSP-1 polypeptide in and an enterokinase cleavage site. The Small Ubiquitin-like Modifier (SUMO) tag facilitates purification on IMIAC (immobilized metal ion affinity chromatography), while the enterokinase cleavage site provides a means for purifying the polypeptide from the fusion protein.

Purity can be assessed by any method known in the art including gel electrophoresis, orthogonal HPLC methods, staining and spectrophotometric techniques. The expressed and purified protein can be analyzed using any assay or method known to one of skill in the art, for example, any described in Section 5. These include assays based on the physical and/or functional properties of the protein, including, but not limited to, analysis by gel electrophoresis, immunoassay and assays of MTSP-1 activity.

6. Additional Modifications

The modified MTSP-1 polypeptides provided herein can be modified to improve or alter pharmacokinetic and pharmacological properties. In particular, the modified MTSP-1 polypeptides can be conjugated to a polymer, such as a PEG moiety or dextran or sialylation to reduce immunogenicity and/or increase half-life in serum and other body fluids including vitreous humor.

a. PEGylation

Polyethylene glycol (PEG) is used in biomaterials, biotechnology and medicine primarily because PEG is a biocompatible, nontoxic, water-soluble polymer that is typically nonimmunogenic (Zhao and Harris, *ACS Symposium Series* 680: 458-72, 1997). In the area of drug delivery, PEG derivatives have been widely used in covalent attachment (i.e., "PEGylation") to proteins to reduce immunogenicity, proteolysis and kidney clearance to increase serum half-life and to enhance solubility (Zalipsky (1995) *Adv. Drug Del. Rev.* 16:157-82). Similarly, PEG has been attached to low molecular weight, relatively hydrophobic drugs to enhance solubility, reduce toxicity and alter biodistribution. Typically, PEGylated drugs are injected as solutions.

A related application is synthesis of crosslinked degradable PEG networks or formulations for use in drug delivery since much of the same chemistry used in design of degradable, soluble drug carriers also can be used in design of degradable gels (Sawhney et al. (1993) *Macromolecules* 26: 581-87). It also is known that intermacromolecular complexes can be formed by mixing solutions of two complementary polymers. Such complexes are generally stabilized by electrostatic interactions (polyanion-polycation) and/or hydrogen bonds (polyacid-polybase) between the polymers involved, and/or by hydrophobic interactions between the polymers in an aqueous surrounding (Krupers et al. (1996) *Eur. Polym J.* 32:785-790). For example, mixing solutions of polyacrylic acid (PAAc) and polyethylene oxide (PEO) under the proper conditions results in the formation of complexes based mostly on hydrogen bonding. Dissociation of these complexes at physiologic conditions has been used for delivery of free drugs (i.e., non-PEGylated). In addition, complexes of complementary polymers have been formed from homopolymers and copolymers.

Numerous reagents for PEGylation are known as are PEG moieties for therapeutic proteins. Reagents and PEG moieties are commercially available. Such reagents include, but are not limited to, reaction of the polypeptide with N-hydroxysuccinimidyl (NHS) activated PEG, succinimidyl mPEG, mPEG2-N-hydroxysuccinimide, mPEG succinimidyl alpha-methylbutanoate, mPEG succinimidyl propionate, mPEG succinimidyl butanoate, mPEG carboxymethyl 3-hydroxybutanoic acid succinimidyl ester, homobifunctional PEG-succinimidyl propionate, homobifunctional PEG propionaldehyde, homobifunctional PEG butyraldehyde, PEG maleimide, PEG hydrazide, p-nitrophenyl-carbonate PEG, mPEG-benzotriazole carbonate, propionaldehyde PEG, mPEG butryaldehyde, branched mPEG2 butyraldehyde, mPEG acetyl, mPEG piperidone, mPEG methylketone, mPEG "linkerless" maleimide, mPEG vinyl sulfone, mPEG thiol, mPEG orthopyridylthioester, mPEG orthopyridyl disulfide, Fmoc-PEG-NHS, Boc-PEG-NHS, vinylsulfone PEG-NHS, acrylate PEG-NHS, fluorescein PEG-NHS, and biotin PEG-NETS (see e.g., Monfardini et al. (1995) *Bioconjugate Chem.* 6:62-69; Veronese et al. (1997) *J. Bioactive Compatible Polymers* 12:197-207; U.S. Pat. Nos. 5,672,662; 5,932,462; 6,495,659; 6,737,505; 4,002,531; 4,179,337; 5,122,614; 5,324,844; 5,446,090; 5,612,460; 5,643,575; 5,766,581; 5,795,569; 5,808,096; 5,900,461; 5,919,455; 5,985,263; 5,990,237; 6,113,906; 6,214,966; 6,258,351; 6,340,742; 6,413,507; 6,420,339; 6,437,025; 6,448,369; 6,461,802; 6,828,401; 6,858,736; U.S. 2001/0021763; U.S. 2001/0044526; U.S. 2001/0046481; U.S. 2002/0052430; U.S. 2002/0072573; U.S. 2002/0156047; U.S. 2003/0114647; U.S. 2003/0143596; U.S. 2003/0158333; U.S. 2003/0220447; U.S. 2004/0013637; US 2004/0235734; WO 05/00360; U.S. 2005/0114037; U.S. 2005/0171328; U.S. 2005/0209416; EP 01064951; EP 0822199; WO 00176640; WO 00/02017; WO 02/49673; WO 94/28024; and WO 01/87925).

In one example, the polyethylene glycol has a molecular weight ranging from about 3 kD to about 50 kD, and typically from about 5 kD to about 30 kD. Covalent attachment of the PEG to the drug (known as "PEGylation") can be accomplished by known chemical synthesis techniques. For example, the PEGylation of protein can be accomplished by reacting NETS-activated PEG with the protein under suitable reaction conditions.

While numerous reactions have been described for PEGylation, those that are most generally applicable confer directionality, use mild reaction conditions, and do not necessitate extensive downstream processing to remove toxic catalysts or bi-products. For instance, monomethoxy PEG (mPEG) has only one reactive terminal hydroxyl, and thus its use limits some of the heterogeneity of the resulting PEG-protein product mixture. Activation of the hydroxyl group at the end of the polymer opposite to the terminal methoxy group is generally necessary to accomplish efficient protein PEGylation, with the aim being to make the derivatized PEG more susceptible to nucleophilic attack. The attacking nucleophile is usually the epsilon-amino group of a lysyl residue, but other amines also can react (e.g., the N-terminal alpha-amine or the ring amines of histidine) if local conditions are favorable. A more directed attachment is possible in proteins containing a single lysine or cysteine. The latter residue can be targeted by PEG-maleimide for thiol-specific modification. Alternatively, PEG hydrazide can be reacted with a periodate oxidized hyaluronan-degrading enzyme and reduced in the presence of $NaCNBH_3$. More specifically, PEGylated CMP sugars can be reacted with a hyaluronan-degrading enzyme in the presence of appropriate glycosyltransferases. One technique is the "PEGylation" technique where a number of polymeric molecules are coupled to the polypeptide in question. When using this technique the immune system has difficulties in recognizing the epitopes on the polypeptide's surface responsible for the formation of antibodies, thereby reducing the immune response. For polypeptides introduced directly into the circulatory system of the human body to give a particular physiological effect (i.e., pharmaceuticals) the typical potential immune response is an IgG and/or IgM response, while polypeptides which are inhaled through the respiratory system (i.e., industrial polypeptide) potentially can cause an IgE response (i.e., allergic response). One of the theories explaining the reduced immune response is that the polymeric molecule(s) shield(s) epitope(s) on the surface of the polypeptide responsible for the immune response leading to antibody formation. Another theory or at least a partial factor is that the heavier the conjugate is, the more reduced immune response is obtained.

Typically, to make the PEGylated modified MTSP-1 polypeptide provided herein, PEG moieties are conjugated, via covalent attachment, to the polypeptides. Techniques for PEGylation include, but are not limited to, specialized linkers and coupling chemistries (see e.g., Harris (2002) *Adv. Drug Deliv. Rev.* 54:459-476), attachment of multiple PEG moieties to a single conjugation site (such as via use of branched PEGs; see e.g., Veronese et al. (2002) *Bioorg. Med. Chem. Lett.* 12:177-180), site-specific PEGylation and/or mono-PEGylation (see e.g., Chapman et al. (1999) *Nature Biotech.* 17:780-783), and site-directed enzymatic PEGylation (see e.g., Sato (2002), *Adv. Drug Deliv. Rev.,* 54:487-504). Methods and techniques described in the art can produce proteins having 1, 2, 3, 4, 5, 6, 7, 8, 9, 10 or more than 10 PEG or PEG derivatives attached to a single protein molecule (see e.g., U.S. Patent Publication No. 2006/0104968).

b. Fusion Proteins

Preparation of fusions of therapeutic proteins to other moieties, such as PEGylation, conjugation to albumin, targeting moieties, such as antibodies and antigen binding fragments thereof, immunoglobulins, fc fusions, fusion with albumin (HSA), XTEN fusion proteins, modification of glycosylation patterns are known (see, Strohl (2015) BioDrugs 29:215-239 for a review of a variety of fusion proteins for improving pharmacokinetic properties of therapeutic proteins). Any of these known modalities for improving pharmacological properties of therapeutics can be applied to the modified MTSP-1 polypeptides provided herein.

Fusion proteins containing a modified MTSP-1 polypeptide provided herein and one or more other polypeptides also are provided. Pharmaceutical compositions containing such fusion proteins formulated for administration by a suitable route are provided. Fusion proteins are formed by linking in any order the modified MTSP-1 polypeptide and another polypeptide, such as an antibody or fragment thereof, growth factor, receptor, ligand and other such agent for the purposes of facilitating the purification of a protease, altering the pharmacodynamic properties of a MTSP-1 polypeptide by directing the modified MTSP-1 polypeptide to a targeted cell or tissue, and/or increasing the expression or secretion of a modified MTSP-1 polypeptide. Within a modified MTSP-1 polypeptide fusion protein, the modified MTSP-1 polypeptide can correspond to all or a catalytically active portion thereof of a MTSP-1 polypeptide. In some embodiments, the MTSP-1 polypeptide or catalytically active portion thereof is a modified MTSP-1 polypeptide provided herein. Fusion proteins provided herein retain substantially all of their specificity and/or selectivity for complement protein C3. Generally, MTSP-1 fusion polypeptides retain at least about 30%, 40%, 50%, 60%, 70%, 80%, 85%, 90% or 95% substrate specificity and/or selectivity compared with a non-fusion MTSP-1 polypeptide, including 96%, 97%, 98%, 99% or greater substrate specificity compared with a non-fusion MTSP-1 polypeptide.

Linkage of a modified MTSP-1 polypeptide and another polypeptide can be effected directly or indirectly via a linker. In one example, linkage can be by chemical linkage, such as via heterobifunctional agents or thiol linkages or other such linkages. Fusion of a MTSP-1 polypeptide to another polypeptide can be to the N- or C-terminus of the MTSP-1 polypeptide. Non-limiting examples of polypeptides that can be used in fusion proteins with a modified MTSP-1 polypeptide provided herein include, for example, a GST (glutathione S-transferase) polypeptide, Fc domain from immunoglobulin G, or a heterologous signal sequence. The fusion proteins can contain additional components, such as E. coli maltose binding protein (MBP) that aid in uptake of the protein by cells (see, International Patent Publication No. WO 01/32711).

A MTSP-1 polypeptide fusion protein can be produced by standard recombinant techniques. For example, DNA fragments encoding the different polypeptide sequences can be ligated together in-frame in accordance with conventional techniques, e.g., by employing blunt-ended or stagger-ended termini for ligation, restriction enzyme digestion to provide for appropriate termini, filling-in of cohesive ends as appropriate, alkaline phosphatase treatment to avoid undesirable joining, and enzymatic ligation. In another embodiment, the fusion gene can be synthesized by conventional techniques including automated DNA synthesizers. Alternatively, PCR amplification of gene fragments can be carried out using anchor primers that give rise to complementary overhangs between two consecutive gene fragments that can subsequently be annealed and reamplified to generate a chimeric gene sequence (see, e.g., Ausubel et al. (eds.) CURRENT PROTOCOLS IN MOLECULAR BIOLOGY, John Wiley & Sons, 1992). Moreover, many expression vectors are commercially available that already encode a fusion moiety (e.g., a GST polypeptide). A MTSP-1-encoding nucleic acid can be cloned into such an expression vector such that the fusion moiety is linked in-frame to the MTSP-1 polypeptide.

Fc fusion proteins, fusion to human serum albumin, fusion to carboxy-terminal peptide are known modifications for improving pharmacokinetics of peptide or biologic drugs. Among these is conjugation to either linear or branched-chain monomethoxy poly-ethylene glycol (PEG), resulting in increases in the molecular mass and hydrodynamic radius, and a decrease in the rate of glomerular filtration by the kidney.

Another approach to for improving pharmacokinetic parameters includes modification of glycosylation patterns, resulting in reduced clearance and extension of half-life.

7. Nucleic Acid Molecules

Nucleic acid molecules encoding MTSP-1 polypeptides are provided herein. Nucleic acid molecules include allelic variants or splice variants of any encoded MTSP-1 polypeptide, or catalytically active portion thereof. In one embodiment, nucleic acid molecules provided herein have at least 50, 60, 65, 70, 75, 80, 85, 90, 91, 92, 93, 94, 95, or 99% sequence identity or hybridize under conditions of medium or high stringency along at least 70% of the full-length of any nucleic acid encoded MTSP-1 polypeptide, or catalytically active portion thereof. In another embodiment, a nucleic acid molecule can include those with degenerate codon sequences of any of the MTSP-1 polypeptides or catalytically active portions thereof such as those provided herein. Exemplary nucleic acid molecules, encoding scaffold or modified proteases, or catalytically active portions thereof, have a sequence of nucleotides as set forth in any of SEQ ID NOS: 60-98.

Nucleic acid molecules, or fusion proteins containing a catalytically active portion of a nucleic acid molecule, operably-linked to a promoter, such as an inducible promoter for expression in mammalian cells also are provided. Such promoters include, but are not limited to, CMV and SV40 promoters; adenovirus promoters, such as the E2 gene promoter, which is responsive to the HPV E7 oncoprotein; a PV promoter, such as the PBV p89 promoter that is responsive to the PV E2 protein; and other promoters that are activated by the HIV or PV or oncogenes.

A MTSP-1 protease provided herein, also can be delivered to the cells in gene transfer vectors. The transfer vectors also can encode additional other therapeutic agent(s) for treatment of the disease or disorder, such as Rheumatoid Arthritis or cardiovascular disease or AMD or DGF, for which the protease is administered. Transfer vectors encoding a protease can be used systemically, by administering the nucleic acid to a subject. For example, the transfer vector can be a viral vector, such as an adenovirus vector. Vectors encoding a protease also can be incorporated into stem cells and such stem cells administered to a subject such as by transplanting or engrafting the stem cells at sites for therapy. For example, mesenchymal stem cells (MSCs) can be engineered to express a protease and such MSCs engrafted at a transplant site for therapy.

G. COMPOSITIONS, FORMULATIONS AND DOSAGES

Pharmaceutical compositions containing modified MTSP-1 polypeptides, modified MTSP-1 fusion proteins or encoding nucleic acid molecules, can be formulated in any conventional manner by mixing a selected amount of the polypeptide with one or more physiologically acceptable carriers or excipients. Selection of the carrier or excipient is within the skill of the administering profession and can depend upon a number of parameters. These include, for example, the mode of administration (i.e., systemic, oral, nasal, pulmonary, local, topical or any other mode) and disorder treated. The pharmaceutical compositions provided herein can be formulated for single dosage (direct) administration or for dilution or other modification. The concentrations of the compounds in the formulations are effective for delivery of an amount, upon administration, that is effective for the intended treatment. Typically, the compositions are formulated for single dosage administration. To formulate a composition, the weight fraction of a compound or mixture thereof is dissolved, suspended, dispersed or otherwise mixed in a selected vehicle at an effective concentration such that the treated condition is relieved or ameliorated. Pharmaceutical carriers or vehicles suitable for administration of the compounds provided herein include any such carriers known to those skilled in the art to be suitable for the particular mode of administration.

1. Administration of Modified MTSP-1 Polypeptides

The polypeptides can be formulated as the sole pharmaceutically active ingredient in the composition or can be combined with other active ingredients. The polypeptides can be targeted for delivery, such as by conjugation to a targeting agent, such as an antibody. Liposomal suspensions, including tissue-targeted liposomes, also can be suitable as pharmaceutically acceptable carriers. These can be prepared according to methods known to those skilled in the art. For example, liposome formulations can be prepared as described in U.S. Pat. No. 4,522,811. Liposomal delivery also can include slow release formulations, including pharmaceutical matrices such as collagen gels and liposomes modified with fibronectin (see, for example, Weiner et al. (1985) *J Pharm Sci.* 74(9): 922-5).

The active compound is included in the pharmaceutically acceptable carrier in an amount sufficient to exert a therapeutically useful effect in the absence of undesirable side effects on the subject treated. The therapeutically effective concentration can be determined empirically by testing the compounds in known in vitro and in vivo systems, such as the assays provided herein.

The MTSP-1 polypeptides provided herein (i.e., active compounds) can be administered in vitro, ex vivo, or in vivo by contacting a mixture, such as a body fluid, such as the vitreous, or other tissue sample, with a MTSP-1 polypeptide provided herein, including any of the modified MTSP-1 polypeptides provided herein. For example, when administering a compound ex vivo, a body fluid or tissue sample from a subject can be contacted with the MTSP-1 polypeptides that are coated on a tube or filter, such as for example, a true or filter in a bypass machine. When administering in vivo, the active compounds can be administered by any appropriate route, for example, orally, nasally, pulmonary, parenterally, intravenously, intradermally, intravitreally, periocularly, subcutaneously, or topically, in liquid, semi-liquid or solid form and are formulated in a manner suitable for each route of administration. Determination of dosage is within the skill of the physician, and can be a function of the particular disorder, route of administration and subject. Exemplary dosages will be dosed at 0.1-1 mg.

The modified MTSP-1 polypeptide and physiologically acceptable salts and solvates can be formulated for administration by inhalation (either through the mouth or the nose), oral, transdermal, pulmonary, parenteral or rectal administration. For administration by inhalation, the modified MTSP-1 polypeptide can be delivered in the form of an aerosol spray presentation from pressurized packs or a nebulizer with the use of a suitable propellant, e.g., dichlorodifluoromethane, trichlorofluoromethane, dichlorotetrafluoroethane, carbon dioxide or other suitable gas. In the case of a pressurized aerosol, the dosage unit can be determined by providing a valve to deliver a metered amount. Capsules and cartridges of e.g., gelatin for use in an inhaler or insufflator, can be formulated containing a powder mix of a therapeutic compound and a suitable powder base such as lactose or starch.

For pulmonary administration to the lungs, the modified MTSP-1 polypeptide can be delivered in the form of an aerosol spray presentation from a nebulizer, turbonebulizer, or microprocessor-controlled metered dose oral inhaler with the use of a suitable propellant. Generally, particle size of the aerosol is small, such as in the range of 0.5 to 5 microns. In the case of a pharmaceutical composition formulated for pulmonary administration, detergent surfactants are not typically used. Pulmonary drug delivery is a promising non-invasive method of systemic administration. The lungs represent an attractive route for drug delivery, mainly due to the high surface area for absorption, thin alveolar epithelium, extensive vascularization, lack of hepatic first-pass metabolism, and relatively low metabolic activity.

For oral administration, the pharmaceutical compositions can take the form of, for example, tablets, pills, liquid suspensions, or capsules prepared by conventional means with pharmaceutically acceptable excipients such as binding agents (e.g., pregelatinized maize starch, polyvinylpyrrolidone or hydroxypropyl methylcellulose); fillers (e.g., lactose, microcrystalline cellulose or calcium hydrogen phosphate); lubricants (e.g., magnesium stearate, talc or silica); disintegrants (e.g., potato starch or sodium starch glycolate); or wetting agents (e.g., sodium lauryl sulphate). The tablets can be coated by methods well known in the art. Liquid preparations for oral administration can take the form of, for example, solutions, syrups or suspensions, or they can be presented as a dry product for constitution with water or other suitable vehicle before use. Such liquid preparations can be prepared by conventional means with pharmaceutically acceptable additives such as suspending agents (e.g., sorbitol syrup, cellulose derivatives or hydrogenated edible fats); emulsifying agents (e.g., lecithin or acacia); non-aqueous vehicles (e.g., almond oil, oily esters, ethyl alcohol or fractionated vegetable oils); and preservatives (e.g., methyl or propyl-p-hydroxybenzoates or sorbic acid). The preparations also can contain buffer salts, flavoring, coloring and sweetening agents as appropriate.

Preparations for oral administration can be formulated for controlled release of the active compound. For buccal administration the compositions can take the form of tablets or lozenges formulated in conventional manner.

The modified MTSP-1 polypeptides can be formulated as a depot preparation. Such long-acting formulations can be administered by implantation (for example, subcutaneously or intramuscularly) or by intramuscular injection. Thus, for example, the therapeutic compounds can be formulated with suitable polymeric or hydrophobic materials (for example as an emulsion in an acceptable oil) or ion exchange resins, or as sparingly soluble derivatives, for example, as a sparingly soluble salt.

The modified MTSP-1 polypeptide can be formulated for parenteral administration by injection (e.g., by bolus injection or continuous infusion). Formulations for injection can be presented in unit dosage form (e.g., in ampoules or in multi-dose containers) with an added preservative. The compositions can take such forms as suspensions, solutions or emulsions in oily or aqueous vehicles and can contain formulatory agents such as suspending, stabilizing and/or dispersing agents. Alternatively, the active ingredient can be in powder-lyophilized form for constitution with a suitable vehicle, e.g., sterile pyrogen-free water, before use.

The modified MTSP-1 polypeptides can be formulated for ocular or ophthalmic delivery. Ocular drug delivery includes, for example, topical, oral or systemic, and/or injected. For example, a modified MTSP-1 polypeptide(s) or pharmaceutical composition containing a modified MTSP-1 polypeptide(s) can be administered topically, such as in the form of eye drops. In another example, a modified MTSP-1 polypeptide(s) or pharmaceutical composition containing a modified MTSP-1 polypeptide(s) can be administered by periocular and/or intravitreal administration, such as, for example, by periocular or intravitreal injection(s).

The modified MTSP-1 polypeptides or pharmaceutical composition containing modified MTSP-1 polypeptides or nucleic acids encoding modified MTSP-1 polypeptides can be formulated for systemic administration for treatment of DGF. In another example, the modified MTSP-1 polypeptides or pharmaceutical composition containing modified MTSP-1 polypeptides or nucleic acids encoding modified MTSP-1 polypeptides are directly infused or injected into the kidney or into the tissues or organs adjacent or surrounding the transplanted kidney. The modified MTSP-1 polypeptides or pharmaceutical composition containing modified MTSP-1 polypeptides can be administered before the time of allograft transplantation or at the time of transplantation with administration continuing in a chronic fashion, and/or can be administered during a rejection episode in the event such an episode does occur.

The pharmaceutical compositions can be formulated for local or topical application, such as for topical application to the skin (transdermal) and mucous membranes, such as in the eye, in the form of gels, creams, and lotions and for application to the eye or for intracisternal or intraspinal application. Such solutions, particularly those intended for ophthalmic use, can be formulated as 0.01%-10% isotonic solutions and pH about 5-7 with appropriate salts. The compounds can be formulated as aerosols for topical application, such as by inhalation (see, for example, U.S. Pat. Nos. 4,044,126, 4,414,209 and 4,364,923, which describe aerosols for delivery of a steroid useful for treatment inflammatory diseases, particularly asthma).

The concentration of active compound in the drug composition depends on absorption, inactivation and excretion rates of the active compound, the dosage schedule, and amount administered as well as other factors known to those of skill in the art. As described further herein, dosages can be determined empirically using comparisons of properties and activities (e.g., cleavage of one or more complement proteins) of the modified MTSP-1 polypeptide compared to the unmodified and/or wild type and/or reference MTSP-1 polypeptide.

The compositions, if desired, can be presented in a package, in a kit or dispenser device, that can contain one or more unit dosage forms containing the active ingredient. In some examples, the composition can be coated on a device, such as for example on a tube or filter in, for example, a bypass machine. The package, for example, contains metal or plastic foil, such as a blister pack. The pack or dispenser device can be accompanied by instructions for administration. The compositions containing the active agents can be packaged as articles of manufacture containing packaging material, an agent provided herein, and a label that indicates the disorder for which the agent is provided.

Also provided are compositions containing nucleic acid molecules, including expression vectors, encoding the MTSP-1 polypeptides. In some embodiments, the compositions of nucleic acid molecules encoding the MTSP-1 polypeptides and expression vectors encoding them are suitable for gene therapy. Rather than deliver the protein, nucleic acid can be administered in vivo, such as systemically or by other route, or ex vivo, such as by removal of cells, including lymphocytes, introduction of the nucleic therein, and reintroduction into the host or a compatible recipient.

2. Administration of Nucleic Acids Encoding Modified MTSP-1 Polypeptides (Gene Therapy)

MTSP-1 polypeptides can be delivered to cells and tissues by expression of nucleic acid molecules. MTSP-1 polypeptides can be administered as nucleic acid molecules encoding MTSP-1 polypeptides, including ex vivo techniques and direct in vivo expression. Nucleic acids can be delivered to cells and tissues by any method known to those of skill in the art. The isolated nucleic acid can be incorporated into vectors for further manipulation. Exemplary nucleic acids are any that encode or that hybridize under medium to high stringency to a nucleic acid that encodes a MTSP-1 polypeptide, or catalytically active portion thereof having a sequence of amino acids set forth in any of SEQ ID NOS: 21-59. Exemplary nucleic acid molecules, encoding modified MTSP-1 polypeptides, or catalytically active portions thereof, have a sequence of nucleotides as set forth in any of SEQ ID NOS:60-98.

Methods for administering MTSP-1 polypeptides by expression of encoding nucleic acid molecules include administration of recombinant vectors. The vector can be designed to remain episomal, such as by inclusion of an origin of replication or can be designed to integrate into a chromosome in the cell. MTSP-1 polypeptides also can be used in ex vivo gene expression therapy using vectors. Suitable gene therapy vectors and methods of delivery are known to those of skill in the art. For example, cells can be engineered to express a modified MTSP-1 polypeptide, such as by integrating MTSP-1 polypeptide encoding nucleic acid into a genomic location, either operatively linked to regulatory sequences or such that it is placed operatively linked to regulatory sequences in a genomic location. Such cells then can be administered locally or systemically to a subject, such as a patient in need of treatment. Exemplary vectors for in vivo and ex vivo gene therapy include viral vectors, and non-viral vectors such as for example, liposomes or artificial chromosomes.

Viral vectors, including, for example adenoviruses, herpes viruses, adeno-associated viruses (AAV), retroviruses, such as lentiviruses, EBV, SV40, cytomegalovirus vectors, vaccinia virus vectors, and others designed for gene therapy can be employed. The vectors can be those that remain episomal or those that can integrate into chromosomes of the treated subject. A modified MTSP-1 polypeptide can be expressed by a virus, which is administered to a subject in need of treatment. Virus vectors suitable for gene therapy include adenovirus, adeno-associated virus, retroviruses, lentiviruses and others noted above. For example, adenovirus expression technology is well-known in the art and adenovirus production and administration methods also are well known. Adenovirus serotypes are available, for example, from the American Type Culture Collection (ATCC, Rockville, Md.). Adenovirus can be used ex vivo, for example, cells are isolated from a patient in need of treatment, and transduced with a modified MTSP-1 polypeptide-expressing adenovirus vector. After a suitable culturing period, the transduced cells are administered to a subject, locally and/or systemically. Alternatively, MTSP-1 polypeptide-expressing adenovirus particles are isolated and formulated in a pharmaceutically-acceptable carrier for delivery of a therapeutically effective amount to prevent, treat or ameliorate a disease or condition of a subject. In one embodiment, the disease to be treated is caused by complement activation. Typically, adenovirus particles are delivered at a dose ranging from 1 particle to $10^{14}$ particles per kilogram subject weight, generally between $10^6$ or $10^8$ particles to $10^{12}$ particles per kilogram subject weight.

The nucleic acid molecules can be introduced into artificial chromosomes and other non-viral vectors. Artificial chromosomes, such as ACES (see, Lindenbaum et al. (2004) *Nucleic Acids Res.* 32(21):e172) can be engineered to encode and express the MTSP-1 polypeptide. Briefly, mammalian artificial chromosomes (MACs) provide a means to introduce large payloads of genetic information into the cell in an autonomously replicating, non-integrating format. Unique among MACs, the mammalian satellite DNA-based Artificial Chromosome Expression System (ACES) can be reproducibly generated de novo in cell lines of different species and readily purified from the host cells' chromosomes. Purified mammalian ACES can then be re-introduced into a variety of recipient cell lines where they have been stably maintained for extended periods in the absence of selective pressure using an ACE System. Using this approach, specific loading of one or two gene targets has been achieved in LMTK(−) and CHO cells.

Another method for introducing nucleic acids encoding the modified MTSP-1 polypeptides is a two-step gene replacement technique in yeast, starting with a complete adenovirus genome (Ad2; Ketner et al. (1994) *Proc. Natl. Acad. Sci. USA* 91: 6186-6190) cloned in a Yeast Artificial Chromosome (YAC) and a plasmid containing adenovirus sequences to target a specific region in the YAC clone, an expression cassette for the gene of interest and a positive and negative selectable marker. YACs are of particular interest because they permit incorporation of larger genes. This approach can be used for construction of adenovirus-based vectors bearing nucleic acids encoding any of the described modified MTSP-1 polypeptides for gene transfer to mammalian cells or whole animals.

The nucleic acids can be encapsulated in a vehicle, such as a liposome, or introduced into a cells, such as a bacterial cell, particularly an attenuated bacterium or introduced into a viral vector. For example, when liposomes are employed, proteins that bind to a cell surface membrane protein associated with endocytosis can be used for targeting and/or to facilitate uptake, e.g., capsid proteins or fragments thereof tropic for a particular cell type, antibodies for proteins which undergo internalization in cycling, and proteins that target intracellular localization and enhance intracellular half-life.

In some embodiments, it is desirable to provide a nucleic acid source with an agent that targets cells, such as an antibody specific for a cell surface membrane protein or a target cell, or a ligand for a receptor on a target cell. Polynucleotides and expression vectors provided herein can be made by any suitable method. Further provided are nucleic acid vectors containing nucleic acid molecules as described above. Further provided are nucleic acid vectors containing nucleic acid molecules as described above and cells containing these vectors.

For ex vivo and in vivo methods, nucleic acid molecules encoding the MTSP-1 polypeptide are introduced into cells that are from a suitable donor or the subject to be treated. Cells into which a nucleic acid can be introduced for purposes of therapy include, for example, any desired, available cell type appropriate for the disease or condition to be treated including, but not limited to, epithelial cells, endothelial cells, keratinocytes, fibroblasts, muscle cells, hepatocytes; blood cells such as T lymphocytes, B lymphocytes, monocytes, macrophages, neutrophils, eosinophils, megakaryocytes, granulocytes; various stem or progenitor cells, including hematopoietic stem or progenitor cells, e.g., such as stem cells obtained from bone marrow, umbilical cord blood, peripheral blood, fetal liver, and other sources thereof.

For ex vivo treatment, cells from a donor compatible with the subject to be treated or cells from a subject to be treated are removed, the nucleic acid is introduced into these isolated cells and the modified cells are administered to the subject. Treatment includes direct administration, such as, for example, encapsulated within porous membranes, which are implanted into the patient (see, e.g., U.S. Pat. Nos. 4,892,538 and 5,283,187). Techniques suitable for the transfer of nucleic acid into mammalian cells in vitro include the use of liposomes and cationic lipids (e.g., DOTMA, DOPE and DC-Chol) electroporation, microinjection, cell fusion, DEAE-dextran, and calcium phosphate precipitation methods. Methods of DNA delivery can be used to express MTSP-1 polypeptides in vivo. Such methods include liposome delivery of nucleic acids and naked DNA delivery, including local and systemic delivery such as using electroporation, ultrasound and calcium-phosphate delivery. Other techniques include microinjection, cell fusion, chromosome-mediated gene transfer, microcell-mediated gene transfer and spheroplast fusion.

In vivo expression of a MTSP-1 polypeptide can be linked to expression of additional molecules. For example, expression of a MTSP-1 polypeptide can be linked with expression of a cytotoxic product such as in an engineered virus or expressed in a cytotoxic virus. Such viruses can be targeted to a particular cell type that is a target for a therapeutic effect. The expressed MTSP-1 polypeptide can be used to enhance the cytotoxicity of the virus.

In vivo expression of a MTSP-1 polypeptide can include operatively linking a MTSP-1 polypeptide encoding nucleic acid molecule to specific regulatory sequences such as a cell-specific or tissue-specific promoter. MTSP-1 polypeptides also can be expressed from vectors that specifically infect and/or replicate in target cell types and/or tissues. Inducible promoters can be used to selectively regulate MTSP-1 polypeptide expression.

Nucleic acid molecules, as naked nucleic acids or in vectors, artificial chromosomes, liposomes and other vehicles can be administered to the subject by systemic administration, topical, local and other routes of administration. When systemic and in vivo, the nucleic acid molecule or vehicle containing the nucleic acid molecule can be targeted to a cell.

Administration also can be direct, such as by administration of a vector or cells that typically targets a cell or tissue. For example, tumor cells and proliferating can be targeted cells for in vivo expression of MTSP-1 polypeptides. Cells used for in vivo expression of a MTSP-1 polypeptide also include cells autologous to the patient. Such cells can be removed from a patient, nucleic acids for expression of a MTSP-1 polypeptide introduced, and then administered to a patient such as by injection or engraftment.

H. THERAPEUTIC USES AND METHODS OF TREATMENT

The modified MTSP-1 polypeptides provided herein target complement protein C3 and permit modulation of complement-mediated diseases and disorders. Therapeutic proteases, such as the modified MTSP-1 polypeptides provided herein, have many potential advantages over traditional therapeutic approaches. Chief among them is the ability to inactivate disease targets in a catalytic manner (i.e. a one to many stoichiometry). Thus, proteases can maintain effective regulation at concentrations significantly below the target concentration. Additional differentiating advantages include (1) irreversible inactivation; (2) low dosing; (3) decreased dosing frequency; (4) small molecular size; (5) the ability to target post-translational modifications; (6) the ability to neutralize high target concentrations; and (7) the ability to target away from the active site. As a therapeutic, a protease must still exhibit the following characteristics: (1) access to the molecular target (extracellular), and (2) possess sufficiently stringent specificity for a target critical to a disease state. The modified MTSP-1 polypeptides provided herein can be used in the treatment of complement-mediated diseases and disorders.

The skilled artisan understands the role of the complement system in disease processes and is aware of a variety of such diseases. Provided is a brief discussion of exemplary diseases and the role of the complement protein C3 in their etiology and pathology. The modified MTSP-1 polypeptides and nucleic acid molecules provided herein can be used for treatment of any condition for which activation of the complement pathway is implicated, particularly inflammatory conditions including acute inflammatory conditions, such as septic shock, and chronic inflammatory conditions, such as Rheumatoid Arthritis (RA). Acute and inflammatory conditions can be manifested as an immune-mediated disease such as for example autoimmune disease or tissue injury caused by immune-complex-mediated inflammation. A complement-mediated inflammatory condition also can be manifested as a neurodegenerative or cardiovascular disease that have inflammatory components. This section provides exemplary uses of, and administration methods for, modified MTSP-1 polypeptides provided herein. These described therapies are exemplary and do not limit the applications of the modified MTSP-1 polypeptides provided herein. Such methods include, but are not limited to, methods of treatment of physiological and medical conditions described and listed below. Such methods include, but are not limited to, methods of treatment of age-related macular degeneration (AMD), geographic atrophy (GA), paroxysmal nocturnal hemoglobinuria (PNH), renal delayed graft function (DGF), sepsis, Rheumatoid arthritis (RA), membranoproliferative glomerulonephritis (MPGN), lupus erythematosus, Multiple Sclerosis (MS), Myasthenia gravis (MG), asthma, inflammatory bowel disease, respiratory distress syndrome, immune complex (IC)-mediated acute inflammatory tissue injury, multi-organ failure, Alzheimer's Disease (AD), Ischemia-reperfusion injuries caused by events or treatments such as myocardial infarct (MI), stroke, cardiopulmonary bypass (CPB) or coronary artery bypass graft, angioplasty, or hemodialysis, chronic obstructive pulmonary disease (COPD), idiopathic pulmonary fibrosis (IPF) and/or Guillain Barre syndrome.

Treatment of diseases and conditions with modified MTSP-1 polypeptides provided herein can be effected by any suitable route of administration using suitable formulations as described herein including, but not limited to, subcutaneous injection, oral, intravitreal, periocular and transdermal administration. If necessary, a particular dosage and duration and treatment protocol can be empirically determined or extrapolated. For example, exemplary doses of wild type or reference MTSP-1 polypeptides can be used as a starting point to determine appropriate dosages. Modified MTSP-1 polypeptides that have more specificity and/or selectivity compared to a wild type or reference MTSP-1 polypeptide can be effective at reduced dosage amounts and or frequencies. Dosage levels can be determined based on a variety of factors, such as body weight of the individual, general health, age, the activity of the specific compound employed, sex, diet, time of administration, rate of excretion, drug combination, the severity and course of the disease, and the patient's disposition to the disease and the judgment of the treating physician. The amount of active ingredient that can be combined with the carrier materials to produce a single dosage form will vary depending upon the host treated and the particular mode of administration.

Upon improvement of a patient's condition, a maintenance dose of a compound or compositions can be administered, if necessary; and the dosage, the dosage form, or frequency of administration, or a combination thereof can be modified. In some cases, a subject can require intermittent treatment on a long-term basis upon any recurrence of disease symptoms.

1. Disease Mediated by Complement Activation

The complement cascade is a dual-edged sword, causing protection against bacterial and viral invasion by promoting phagocytosis and inflammation. Conversely, even when complement is functioning normally, it can contribute to the development of disease by promoting local inflammation and damage to tissues. Thus, pathological effects are mediated by the same mediators that are responsible for the protective roles of complement. For example, the anaphylactic and chemotactic peptide C5a drives inflammation by recruiting and activating neutrophils, C3a can cause pathological activation of other phagocytes, and the membrane attack complex can kill or injure cells. In one example, such as in many autoimmune diseases, complement produces tissue damage because it is activated under inappropriate circumstances such as by antibody to host tissues. In other situations, complement can be activated normally, such as by septicemia, but still contributes to disease progression, such as in respiratory distress syndrome. Pathologically, complement can cause substantial damage to blood vessels (vasculitis), kidney basement membrane and attached endothelial and epithelial cells (nephritis), joint synovium (arthritis), and erythrocytes (hemolysis) if it is not adequately controlled.

Complement has a role in immuno-pathogenesis of a number of disorders, including autoimmune diseases such as rheumatoid arthritis (see, e.g., Wang et al. (1995) *Proc. Natl. Acad. Sci. U.S.A.* 92:8955-8959; Moxley et al. (1987) *Arthritis & Rheumatism* 30:1097-1104), lupus erythematosus (Wang et al. (1996) *Proc. Natl. Acad. Sci. U.S.A.* 90:8563-8568; and Buyon et al. (1992) *Arthritis Rheum.* 35:1028-1037) and acute glomerulonephritis (Couser et al. (1995) *J Am Soc Nephrol.* 5:1888-1894). Other pathologies that involve activation of the complement system include sepsis (see, e.g., Stove et al. (1996) *Clin Diag Lab Immunol* 3:175-183; Hack et al. (1989) *Am. J. Med.* 86:20-26), respiratory distress syndrome (see, e.g., Zilow et al. (1990) *Clin. Exp. Immunol.* 79:151-157; and Stevens et al. (1986) *J. Clin. Invest.* 77:1812-1816), multiorgan failure (see, e.g., Hecke et al. (1997) *Shock* 7:74; and Heideman et al. (1984) *J. Trauma* 24:1038-1043), ischemia-reperfusion injury such as occurs in cardiovascular disease such as stroke or myocardial infarct (Austen W G et al. (2003) *Int J Immunopathol Pharm* 16(1):1-8), age-related macular degeneration (Bradley et al. (2011) Eye 25: 683-693; Gemenetzi et al. (2016) *Eye* 30: 1-14) and renal delayed graft function (Danobeitia et al. (2013) [abstract]. *Am J Transplant.* 13 (suppl 5); Yu et al. (2016) *Am J Transplant* 16(9):2589-2597; Castallano et al. (2010) *Am J Pathol* 176(4):1648-1659). Some exemplary examples of complement-mediated diseases are described below.

a. Rheumatoid Arthritis

Rheumatoid arthritis (RA) is a chronic inflammatory illness. It is an autoimmune disease in which the immune system attacks normal tissue components as if they were invading pathogens. The inflammation associated with rheumatoid arthritis primarily attacks the linings of the joints. The membranes lining the blood vessels, heart, and lungs also can become inflamed. RA is characterized by activated B cells and plasma cells that are present in inflamed synovium, and in established disease lymphoid follicles and germinal centers. This results in high levels of local immunoglobulin production and the deposition of immune complexes, which can include IgG and IgM rheumatoid factors, in the synovium and in association with articular cartilage which can serve as initiators of the complement cascade. Elevated levels of complement components, such as C3a, C5a, and C5b-9 have been found within the inflamed rheumatoid joints. These complement components can exacerbate the inflammation associated with RA by inducing a variety of proinflammatory activities such as for example, alterations in vascular permeability, leukocyte chemotaxis, and the activation and lysis of multiple cell types.

b. Sepsis

Sepsis is a disease caused by a serious infection, such as a bacterial infection, leading to a systemic inflammatory response. The bacterial cell wall component, lipopolysaccharide, is often associated with sepsis, although other bacterial, viral, and fungal infections can stimulate septic symptoms. Septic shock often results if the natural immune system of the body is unable to defend against an invading microorganism such that, for example, the pro-inflammatory consequences of the immune response is damaging to host tissues. The early stages of sepsis are characterized by excessive complement activation resulting in increased production of complement anaphylatoxins, such as C3a, C4a, and C5a which act to increase vascular permeability, stimulate superoxide production from neutrophils and stimulate histamine release. The actions of C5a can contribute to a productive immune response to a bacterial infection, but if left unregulated, C5a also can be severely damaging. In an *E. coli*-induced model of inflammation, blockade of C5a improved the outcome of septic animals by limiting C5a-mediated neutrophil activation that can lead to neutrophil-mediated tissue injury.

The continued impairment of the innate immune response to a bacterial infection often leads to chronic sepsis or septic shock, which can be life-threatening. In the late stage of sepsis, it is the "dormant" activity of neutrophils, as opposed to the hyperactivity that occurs in the early phases, that contributes to continued disease. In the late stage, the major functions of neutrophils including chemotaxis, respiratory burst activity, and ability for bacterial killing are reduced. Complement, and in particular C5a, also plays a role in the later stages of sepsis. Excessive production of C5a during sepsis is associated with the "deactivation" of blood neutrophils, a process that has been linked to C5a-induced down regulation of its own receptor, C5aR, on neutrophils (Guo et al. (2003) *FASEB J* 13:1889). The reduced levels of C5aR on neutrophils correlates with a diminished ability of blood neutrophils to bind C5a, impaired chemotactic responses, a loss of superoxide productions, and impaired bactericidal activity. C5aR levels, however, can begin to "recover" at later stages of sepsis and correlate with instances of beneficial disease outcome.

c. Multiple Sclerosis

Multiple sclerosis (MS) and its animal model experimental allergic encephalomyelitis (EAE) are inflammatory demyelinating diseases of the central nervous system (CNS). In MS, inflammation of nervous tissue causes the loss of myelin, a fatty material which acts as a sort of protective insulation for the nerve fibers in the brain and spinal cord. This demyelination leaves multiple areas of scar tissue (sclerosis) along the covering of the nerve cells, which disrupts the ability of the nerves to conduct electrical impulses to and from the brain, producing the various symptoms of MS. MS is mediated by activated lymphocytes, macrophages/microglia and the complement system. Complement activation can contribute to the pathogenesis of these diseases through its dual role: the ability of activated terminal complex C5b-9 to promote demyelination and the capacity of sublytic C5b-9 to protect oligodendrocytes (OLG) from apoptosis.

d. Alzheimer's Disease

Alzheimer's disease (AD) is characterized by tangles (abnormal paired helical filaments of the protein tau, which normally binds to microtubules) and plaques (extracellular deposits composed primarily of beta-amyloid protein) within the brain. Although, the precise cause of AD is not entirely clear, chronic neuroinflammation in affected regions of AD brains indicate that proinflammatory mediators can play a role. The tangles and plaques within an AD brain are deposited with activated complement fragments, such as for example, C4d and C3d. Likewise, dystrophic neurites in AD brain can be immunostained for MAC, indicating autocatalytic attack of these neurites and concomitant neurite loss in AD. Activation of complement in AD occurs by an antibody-independent mechanism induced by aggregated amyloid-beta protein. Further, the complement cascade can be activated by the pentraxins, C-reactive protein (CRP), and amyloid P (AP) which are all upregulated in AD (McGeer et al., (2002) *Trends Mol Med* 8:519). The activation of complement in AD, marked by increases in complement mediators, is not adequately controlled by a compensatory upregulation of complement regulatory proteins such as, for example, CD59. Thus, the proinflammatory consequences of complement activation exacerbates AD progression and likely contributes to neurite destruction.

e. Ischemia-Reperfusion Injury

Ischemia-reperfusion injury is the injury sustained after an ischemic event and subsequent restoration of blood flow and results from the inflammatory response to a hypoxic insult. Ischemia-reperfusion damage can be acute as during cardiac surgery procedures, such as for example following open heart surgery or angioplasty, or chronic as with congestive heart failure or occlusive cardiovascular disease. Examples of injuries that can cause ischemia-reperfusion injury include myocardial infarct (MI) and stroke. The initiation of an inflammatory response is likely caused by the increase in tissue oxygen levels that occur with reperfusion and the concomitant accumulation of metabolites that can generate oxygen free radicals which are immunostimulatory. Ischemia-reperfusion injury is associated with a variety of events including severity of myocardial infarction, cerebral ischemic events, intestinal ischemia, and many aspects of vascular surgery, cardiac surgery, trauma, and transplantation. The injury is manifested by inflammatory events of the innate immune system, particularly activation of the complement system, in response to newly altered tissue as non-self. As such ischemia-reperfusion injury is characterized by tissue edema caused by increased vascular permeability, and an acute inflammatory cell infiltrate caused by influx of polymorphonuclear leukocytes.

Activation of the complement system plays a role in the inflammatory events of ischemia-reperfusion injury. The ischemia injury results in alterations of the cell membrane, affecting lipids, carbohydrates, or proteins of the external surface such that these exposed epitopes are altered and can act as neo-antigens (modified self-antigens). Circulating IgM recognize and bind the neo-antigens to form immune complexes on the injured cell surface. The antigen-antibody complexes formed are classic activators of the classical pathway of complement, although all pathways are likely involved in some way to the exacerbating effects of the injury. The involvement of the classical pathway of complement to ischemia-reperfusion injury is evidenced by mice genetically deficient in either C3 or C4 that display equal protection from local injury in a hind limb and animal model of injury (Austen et al. (2003) *Int J Immunopath Pharm* 16:1). Conversely, in a kidney model of ischemia injury, C3-, C5-, and C6-deficient mice were protected whereas C4-deficient mice were not, indicating the importance of the alternative complement pathway (Guo et al. (2005) *Ann Rev Immunol* 23:821). Mediators induced upon complement activation initiate an inflammatory response directed at the cell membrane at the site of local injury.

A major effector mechanism of complement in ischemia-reperfusion injury is the influx and activation of neutrophils to the inflamed tissue by complement components, such as, for example, C5a. Activation of neutrophils results in increased production of reactive oxygen species and the release of lysosomal enzymes in local injured organs which ultimately results in apoptosis, necrosis, and a loss or organ function. The generation of the terminal MAC, C5b-9, also contributes to local tissue injury in ischemia-reperfusion injury.

f. Ocular Disorders

In the normal eye, the complement system is continuously activated at low levels; membrane-bound and soluble intraocular complement regulatory proteins tightly regulate this spontaneous complement activation. Low level complement activation protects against pathogens without causing any damage to self-tissue and vision loss. The complement system and complement regulatory proteins control the intraocular inflammation in autoimmune uveitis and play an important role in the development of corneal inflammation, age-related macular degeneration and diabetic retinopathy. The complement system plays an important role in the pathogenesis of diabetic retinopathy (see, e.g., Ghosh et al. (2015) *Endocr Rev* 36:272-288) as well as diabetic neuropathy and diabetic cardiovascular disease. Spontaneous complement activation can cause damage to the corneal tissue after the infection. Complement inhibition is a relevant therapeutic target in the treatment of various ocular diseases (see, e.g., Purushottam et al. (2007) *Mol Immunol.* 44:3901-3908).

Age-Related Macular Degeneration (AMD)

Age-related macular degeneration is a clinical term that describes a variety of diseases that are characterized by the progressive loss of central vision. AMD is the leading cause of vision loss in aged individuals in many industrialized countries (Jager et al. (2008) *N Engl J Med* 358:2606-2617).

Vision loss occurs due to the progressive degeneration of the macula, the region at the back of the eye comprising a high density of cone photoreceptors, which is specialized for high-acuity, central vision.

AMD can manifest as Dry (non-neovascular) AMD and/or Wet AMD. Dry AMD is the more common (85-90% of cases) and milder form of AMD, and is characterized by small, round, white-yellow lesions (drusen) in and under the macula. Advanced dry AMD, or geographic atrophy, leads to thinning of the retina due to loss of PRE photoreceptors, deterioration of the macula and eventual blindness. Although rarer, vision loss associated with wet AMD is generally more dramatic than in dry AMD. Wet AMD includes the formation of pathogenic blood vessels, termed choroidal neovascularization (CNV), in which abnormal blood vessels develop beneath the retinal pigment epithelium (RPE) layer of the retina. CNV invasion of the retina from the underlying choroid through fractures in Bruch membrane, the extracellular matrix between the choroid and the retinal pigment epithelium (RPE), or their breakage can cause vision loss in AMD (e.g., due to subretinal hemorrhage and/or scarring).

Early clinical hallmarks of AMD include thickening of the Bruch membrane and the appearance of drusen (Gass, J. D. (1972) *Trans. Am. Ophthalmol. Soc.* 70: 409-36), which are extracellular lipoproteinaceous deposits consisting of aggregated proteins, such as albumin, apolipoprotein E (APOE), components of the complement pathway (e.g., complement factor H (CFH), C1q, C3, C5, C5b, C6, C7, C8, C9, and vitronectin (Hageman et al., (2001) *Prog. Retin. Eye. Res.* 29:95-112; Hageman et al. (2005) *Proc. Nat. Acad. Sci.* 102: 7227-7232; Mullins et al. (2000) *FASEB J* 14:835-846; Anderson et al., (2010) *Pro. Retin. Eye Res.* 29:95-112), immunoglobulins and/or amyloid-β (Crabb et al. (2002) *Proc Natl Acad Sci* 99:14682-14687; Johnson et al. (2002) 99:11830-11835) and lipids and cellular components that are localized between the RPE and the Bruch membrane. Inflammation in AMD is mediated by the deregulation of the alternative complement pathway. Complement components C3 and C5 are principal constituents of drusen in patients with AMD (Mullins et al., (2000) *FASEB J* 14, 835-46; Johnson et al., (2000) *Exp Eye Res* 70, 441-9; Anderson et al., (2002) *Am J Ophthalmol* 134, 411-31; and Leitner et al., (2001) *Exp Eye Res* 73, 887-96). It is hypothesized that drusen biogenesis involves chronic inflammatory processes that either can trigger complement activation and formation of MAC, which can lyse RPE cells or disturb physiological homeostasis in RPE cells, leading to inflammation characteristic of AMD (Johnson et al. (2001) *Exp Eye Res* 73, 887-896). Complement proteins (e.g., C3d) also were detected in blood in AMD patients (Scholl et al., (2008) *PLoS One* 3: e2593), indicating that AMD-induced inflammation can be systemic. There is genetic evidence for a role in complement in the pathogenesis of dry AMD (Klein et al. (2005) *Science* 308(5720):385-389; Yates et al., (2007) *NEJM* 357:553-561) and compstatin (and compstatin derivatives APL-1 and APL-2) and POT-4 (Potentia Pharmaceuticals), small peptide inhibitors of C3, may slow the progression of geographic atrophy (Ricklin et al. (2008) *Adv. Exp. Med. Biol.* 632: 273-292) in AMD, indicating that C3 (i.e., C3 inhibition) is a viable target for AMD treatment. Recent clinical results have validated these conclusions and findings. C3 is a viable clinical target for complement mediated disorders and conditions or for those in which complement plays a role.

g. Organ Transplantation and Delayed Graft Function (DGF)

Complement plays a role in the pathogenesis of ischemia-reperfusion injury The mechanism of renal reperfusion injury depends on the generation of C5a and C5b-9, both of which have direct toxicity on the renal tubules contributing to acute tubular necrosis and apoptosis, and leading to post-ischemic acute renal failure and tissue fibrosis. In turn, the generation of these terminal pathway components depends on intra-renal synthesis of C3 and availability of other complement components that are essential for complement activation. The level of expression of C3 in the donor organ is strongly dependent on the cold ischaemic time (Elham et al. (2010) *Curr Opin Organ Transplant.* 15:486/191).

Rejection in solid organ transplantation is influenced by the initial inflammatory response and subsequent adaptive alloimmune response, both of which are affected by various complement components. Complement proteins play a significant part in organ damage following transplantation in the process of ischaemia reperfusion and in modulating the activation of the adaptive immune response. Inhibiting complement or modulating the function of complement proteins molecules can reduce transplant organ damage and increase the organ lifespan (see, e.g., Elham et al. (2010) *Curr Opin Organ Transplant.* 15:486-491). Targeting complement components for therapeutic intervention can reduce organ damage at the time of organ recovery, transfer and after transplantation. Exemplary of such organs is the kidney. The modified MTSP-1 polypeptides provided herein can be administered to mitigate and/or treat organ damage following transplantation.

Delayed graft function (DGF), such as delayed graft function of the kidney, liver, lung, and/or heart, is a condition occurring in a subset of organ transplant patients in which the transplanted organ fails to function normally immediately following transplant. Other possible transplants include, but are not limited to, vascular tissue, eye, cornea, lens, skin, bone marrow, muscle, connective tissue, gastrointestinal tissue, nervous tissue, bone, stem cells, islets, cartilage, hepatocytes, and hematopoietic cells. Renal DGF is characterized by acute necrosis of the renal allograft and has been clinically defined by the need for dialysis shortly following transplantation. Acute kidney injury during the transplant process frequently manifests as DGF. The pathology underlying DGF is complex with contributions from donor-derived factors such as donor age and duration of ischemia, and recipient factors such as reperfusion injury, immunological responses and treatment with immunosuppressant medications.

Components of the complement cascade and complement activation play a critical role as mediators of transplant rejection and ischemia-reperfusion injury leading to DGF. Animal studies have established a key role for complement in ischemic reperfusion injury. For example, Eculizumab, a humanized monoclonal antibody directed against C5, blocks complement activation and were shown to prevent delayed graft function in a subset of high-risk kidney transplant patients (see, e.g., Horizon Scanning Research and Intelligence Centre brief, 2016 September; Johnson et al. (2015) *Curr Opin Organ Transplant* 20(6):643-651; Yu et al. (2016) *Am J Transplant* 16(9):2589-2597). Granular C4d deposition was associated with DGF in human renal allograft recipients (Kilda et al. (2014) *Transpl Int* 27(3):312-321). Increased C3 production is associated with kidney transplant rejection (Pratt et al. (2002) *Nat Med* 8(6):582-587; Damman et al. (2011) *Nephrol Dial Transplant* 26(7):2345-2354). Hence, the modified MTSP-1 polypeptides provided herein, can be used as a therapeutic for preventing or ameliorating or eliminating transplant rejection and DGF.

2. Therapeutic Uses
a. Immune-Mediated Inflammatory Diseases

Modified MTSP-1 polypeptides described herein can be used to treat inflammatory diseases. Inflammatory diseases that can be treated with proteases include acute and chronic inflammatory diseases. Exemplary inflammatory diseases include central nervous system diseases (CNS), autoimmune diseases, airway hyper-responsiveness conditions such as in asthma, rheumatoid arthritis, inflammatory bowel disease, and immune complex (IC)-mediated acute inflammatory tissue injury.

Experimental autoimmune encephalomyelitis (EAE) can serve as a model for multiple sclerosis (MS) (Piddlesden et al. (1994) *J Immunol* 152:5477). EAE can be induced in a number of genetically susceptible species by immunization with myelin and myelin components such as myelin basic protein, proteolipid protein and myelin oligodendrocyte glycoprotein (MOG). For example, MOG-induced EAE recapitulates essential features of human MS including the chronic, relapsing clinical disease course the pathohistological triad of inflammation, reactive gliosis, and the formation of large confluent demyelinated plaques. Modified MTSP-1 polypeptides can be assessed in EAE animal models. Modified MTSP-1 polypeptides are administered, such as by daily intraperitoneal injection, and the course and progression of symptoms is monitored compared to control animals. The levels of inflammatory complement components that can exacerbate the disease also can be measured by assaying serum complement activity in a hemolytic assay and by assaying for the deposition of complement components, such as for example C1, C3 and C9.

Complement activation modulates inflammation in diseases such as rheumatoid arthritis (RA) (Wang et al., (1995) *PNAS* 92:8955). Modified MTSP-1 polypeptides can be used to treat RA. For example, MTSP-1 polypeptides can be injected locally or systemically. Modified MTSP-1 polypeptides can be dosed daily or weekly. PEGylated MTSP-1 polypeptides can be used to reduce immunogenicity. In one example, type II collagen-induced arthritis (CIA) can be induced in mice as a model of autoimmune inflammatory joint disease that is histologically similar to RA characterized by inflammatory synovitis, pannus formation, and erosion of cartilage and bone. To induce CIA, bovine type II collagen (B-CII) in the presence of complete Freund's adjuvant can be injected intradermally at the base of the tail. After 21 days, mice can be re-immunized using the identical protocol. To examine the effects of a MTSP-1 polypeptide, 3 weeks following the initial challenge with B-CII, a MTSP-1 polypeptide or control can be administered intraperitoneally twice weekly for 3 weeks. Mice can be sacrificed 7 weeks following the initial immunization for histologic analysis. To assess the therapeutic effect of a MTSP-1 polypeptide on established disease, a MTSP-1 polypeptide can be administered daily for a total of 10 days following the onset of clinical arthritis in one or more limbs. The degree of swelling in the initially affected joints can be monitored by measuring paw thickness using calipers. In both models, serum can be drawn from mice for hemolytic assays and measurement of complement markers of activation such as for example C5a and C5b-9. In another example, primate models are available for RA treatments. Response of tender and swollen joints can be monitored in subjects treated with MTSP-1 polypeptides and controls to assess MTSP-1 polypeptide treatment.

Modified MTSP-1 polypeptide can be used to treat immune complex (IC)-mediated acute inflammatory tissue injury. IC-mediated injury is caused by a local inflammatory response against IC deposition in a tissue. The ensuing inflammatory response is characterized by edema, neutrophilia, hemorrhage, and finally tissue necrosis. IC-mediated tissue injury can be studied in an in vivo Arthus (RPA) reaction. Briefly, in the RPA reaction, an excess of antibody (such as for example rabbit IgG anti-chicken egg albumin) is injected into the skin of animals, such as for example rats or guinea pigs, that have previously been infused intravenously with the corresponding antigen (i.e., chicken egg albumin) (Szalai et al., (2000) *J Immunol* 164:463). Immediately before the initiation on an RPA reaction, a MTSP-1 polypeptide, or a bolus control, can be administered at the same time as the corresponding antigen by an intravenous injection via the right femoral vein. Alternatively, a MTSP-1 polypeptide can be administered during the initial hour of the RPA reaction, beginning immediately after injection of the antigen and just before dermal injection of the antibody. The effects of a MTSP-1 polypeptide on the generation of complement-dependent IC-mediated tissue injury can be assessed at various times after initiation of RPA by collecting blood to determine the serum hemolytic activity, and by harvesting the infected area of the skin for quantitation of lesion size.

Therapeutic MTSP-1 polypeptides, such as those described herein, can be used to treat sepsis and severe sepsis that can result in lethal shock. A model of complement-mediated lethal shock can be used to test the effects of a MTSP-1 polypeptide as a therapeutic agent. In one such example, rats can be primed with a trace amount of lipopolysaccharide (LPS), followed by the administration of a monoclonal antibody against a membrane inhibitor of complement (anti-Crry) (Mizuno et al., (2002) *Int Arch Allergy Immunol* 127:55-62). A MTSP-1 polypeptide or control can be administered at any time during the course of initiation of lethal shock such as before LPS priming, after LPS priming, or after anti-Crry administration and the rescue of rats from lethal shock can be assessed.

b. Neurodegenerative Disease

Complement activation exacerbates the progression of Alzheimer's disease (AD) and contributes to neurite loss in AD brains. Modified MTSP-1 polypeptides described herein can be used to treat AD. Mouse models that mimic some of the neuropathological and behavioral features of AD can be used to assess the therapeutic effects of MTSP-1 polypeptides. Examples of transgenic mouse models include introducing the human amyloid precursor protein (APP) or the presenilin 1 (PS1) protein with disease-producing mutations into mice under the control of an aggressive promoter. These mice develop characteristics of AD including increases in beta-amyloid plaques and dystrophic neurites. Double transgenic mice for APP and PS1 mutant proteins develop larger numbers of fibrillar beta-amyloid plaques and show activated glia and complement factors associated with the plaque. MTSP-1 polypeptides can be administered, such as by daily intraperitoneal or intravenous injections, and the course and progression of symptoms is monitored compared to control animals.

c. Cardiovascular Disease

Modified MTSP-1 polypeptides provided herein can be used to treat cardiovascular disease. MTSP-1 polypeptides can be used in the treatment of cardiovascular diseases including ischemia reperfusion injury resulting from stroke, myocardial infarction, cardiopulmonary bypass, coronary artery bypass graft, angioplasty, or hemodialysis. MTSP-1 polypeptides also can be used in the treatment of the inflammatory response associated with cardiopulmonary bypass that can contribute to tissue injury. Generally, a MTSP-1 polypeptide can be administered prior to, concomitantly with, or subsequent to a treatment or event that induces a complement-mediated ischemia reperfusion injury. In one example, a MTSP-1 polypeptide can be administered to a subject prior to the treatment of a subject by a complement-mediated, ischemic-injury inducing event, such as for example coronary artery bypass graft of angioplasty.

Effects of a MTSP-1 polypeptide on treatment of ischemia reperfusion injury can be assessed in animal models of the injury. In one such model, myocardial ischemia is induced in rabbits that have had an incision made in their anterior pericardium by placing a 3-0 silk suture around the left anterior descending (LAD) coronary artery 5-8 mm from its origin and tightening the ligature so that the vessel becomes completely occluded (Buerke et al., (2001) *J Immunol* 167:5375). A MTSP-1 polypeptide, such as for example a modified MTSP-1 polypeptide, or a control vehicle such as saline, can be given intravenously in increasing doses as a bolus 55 minutes after the coronary occlusion (i.e., 5 minutes before reperfusion). Five minutes later (i.e., after a total of 60 minutes of ischemia) the LAD ligature can be untied and the ischemic myocardium can be reperfused for 3 hours. At the end of the reperfusion period, the ligature around the LAD is tightened. Effects of a MTSP-1 polypeptide on ischemia injury can be analyzed by assessing effects on myocardial necrosis, plasma creatine kinase levels, and markers of neutrophil activation such as for example myeloperoxidase activity and superoxide radical release.

In another model of complement-mediated myocardial injury sustained upon perfusion of isolated mouse hearts with Krebs-Henseleit buffer containing 6% human plasma, treatment with modified MTSP-1 polypeptides can be used to limit tissue damage to the heart. In such an example, the buffer used to perfuse the hearts can be supplemented with varying doses of modified MTSP-1 polypeptides. The perfused hearts can be assayed for deposition of human C3 and C5b-9, coronary artery perfusion pressure, end-diastolic pressure, and heart rate.

Modified MTSP-1 polypeptides provided herein can be used as therapeutics prior to or following Cardiopulmonary Bypass (CPB) or coronary artery bypass graft to inhibit the inflammatory immune response that often follows bypass and that can contribute to tissue injury. An in vitro recirculation of whole blood in an extracorporeal bypass circuit can be used to stimulate platelet and leukocyte changes and complement activation induced by CPB (Rinder et al. (1995) *J. Clin. Invest.* 96:1564). In such a model, addition of a MTSP-1 polypeptide or control buffer, in varying doses, can be added to a transfer pack already containing blood from a healthy donor and porcine heparin, just prior to addition of the blood to the extracorporeal circuit. Blood samples can be drawn at 5, 15, 30, 45, 60, 75, and 90 minutes after recirculation and assayed for complement studies such as for example hemolytic assays and/or complement activation assays to measure for C5a, C3a, and/or sC5b-9. A pretreatment sample of blood drawn before its addition to the extracorporeal circuit can be used as a control. Flow cytometry of blood samples can be performed to determine levels of adhesion molecules on populations of circulating leukocytes (i.e. neutrophils) in the blood such as for example CD11b and P-selectin levels.

d. Age-Related Macular Degeneration (AMD)

Modified MTSP-1 polypeptides described herein can be used to treat Age-Related Macular Degeneration (AMD). Age-Related Macular Degeneration (AMD) that can be treated with proteases include wet AMD, dry AMD and geographic atrophy. Numerous animal models of AMD are available that mimic many of the characteristics of the human disorder (Pennesi et al. (2012) *Mol. Aspects Med.* 33(4):487-509). Mutations in complement pathway genes were shown to increase or decrease susceptibility to AMD (Edwards et al. (2005) *Science* 308(5720):421-424; Hageman et al. (2005) *Proc. Nat. Acad. Sci* 102(20):7227-7232; Klein et al. (2005) *Science* 308(5720):385-389). For example, in complement factor H (CFH), which normally interacts with C3b, the single nucleotide polymorphism Y402H prevented binding of C3b with factor B, leading to inhibition of C3 formation. Y402H is associated with an increased risk of AMD in people and the mutation was previously identified in 43-59% of AMD patients (Haines et al. (2005) *Science* 308(5720):419-421; Thakkinstian et al. (2006) *Hum. Mol. Genet.* 15(18):2784-2790; Zareparsi et al. (2005) *Am. J. Hum. Genet.* 77(1):149-153).

Genetically modified mice that lack the ability to make CFH develop characteristics of AMD, including retinal abnormalities, decreased visual acuity and complement deposition (Coffey et al. (2007) *Proc. Nat. Acad. Sci.* 104: 16651-16656). Mutations in complement proteins Factor B (Montes et al. (2009) *Proc. Nat. Acad. Sci.* 106(11):4366-4371), C2 (Gold et al. (2006) *Nat. Genet.* 38(4):458-462), and C3 (Mailer et al. (2007) *Nat. Genet.* 39(10):1200-1201; Yates et al. (2007) *New Engl. J. Med.* 357(6):553-561) are associated with increased or decreased risk of developing AMD based on their impact on expression and/or activity of the various complement proteins (Reynolds et al. (2009) *Invest. Ophthalmol. Vis. Sci.* 50(12):5818-5827).

Modified MTSP-1 proteases, such as modified MTSP-1 proteases provided herein, wherein an activity, such as substrate specificity or selectivity, of the MTSP-1 protease for cleaving complement protein C3 is altered can be used as therapeutics. The modified MTSP-1 polypeptides provided herein are administered, for example, by monthly or bi-monthly intravitreal injection, and the course and progression of symptoms is monitored compared to control animals or subjects. The levels of complement components that can exacerbate the disease also can be measured by assaying serum complement activity in a hemolytic assay and by assaying for the deposition of complement components, such as for example C1, C3 and C9.

Complement activation plays a role in disease progress in Age-Related Macular Degeneration (AMD) (see e.g., Bradley et al., (2011) *Eye* 25:683-693; Gemenetzi et al. (2016) *Eye* 30:1-14). Modified MTSP-1 polypeptides can be used to treat AMD. For example, MTSP-1 polypeptides or a pharmaceutical composition containing MTSP-1 polypeptides, such as the modified MTSP-1 polypeptides described herein, can be injected intravitreally or periocularly. Modified MTSP-1 polypeptides can be dosed daily or weekly or less frequently, such as for example, monthly or less frequently, such as bi-monthly. For AMD, modified MTSP-1 polypeptides that are further "modified" for extended duration in the eye (e.g., fusion proteins, PEGylation, etc.) monthly dosing can be used. Also, depending upon the particular modification, bi-monthly dosing and tri-monthly (every 3 months) also are contemplated. The modified MTSP-1 polypeptides can be modified, such as by PEGylation, to reduce potential immunogenicity and/or to increase serum half-life. For AMD, modified MTSP-1 polypeptides that are not further modified for extended duration in the eye (e.g., fusion proteins, PEGylated proteins) monthly or bi-monthly administration is contemplated. If modified, such as by PEGylation, dosing can be effected every 3 months or more.

e. Organ Transplant

Delayed Graft Function

Modified MTSP-1 polypeptides described herein can be used to treat Delayed Graft Function (DGF), including DGF, such as, for example, DGF as a result of Ischemia-Reperfusion Injury in kidney transplant recipients. MTSP-1 polypeptides also can be used in the treatment of the inflammatory response associated with organ transplant that can contribute to tissue injury. Generally, a MTSP-1 polypeptide can be administered prior to, concomitantly with, or subsequent to a treatment or event that induces a complement-mediated ischemia reperfusion injury. In one example, a MTSP-1 polypeptide can be administered to a subject prior to the treatment of a subject by a complement-mediated, ischemic-injury inducing event, such as for example kidney transplant or kidney allograft.

Effects of a MTSP-1 polypeptide on treatment of delayed graft function, for example delayed graft function as a result of ischemia-reperfusion injury, can be assessed in animal models of the injury, which mimic characteristics displayed in human kidney allografts or transplants.

The presence of early biomarkers of early graft dysfunction leading to DGF, including biomarkers for tubular epithelial cell injury can indicate the need for therapeutics. Biomarkers of DGF (i.e., serum creatine) have been identified (Malyszko et al. (2015) *Nature Scientific Reports* 5:11684; Wanga et al. (2015) *PLoS One* 10(9):e0136276). Early detection of biomarkers for DGF and therapeutic intervention, such as, for example, therapeutic treatment with a modified MTSP-1 polypeptide, can improve clinical outcomes.

Complement activation modulates disease progress in disorders such as delayed graft function after organ transplant, for example kidney transplant (Yu et al. (2016) *Am J of Transplantation* 16(9):2589-2597). Modified MTSP-1 polypeptides can be used to treat DGF. For example, MTSP-1 polypeptides can be administered for systemic delivery or can be injected directly into the graft or the surrounding tissues. Modified MTSP-1 polypeptides can be administered prior to, during or after transplant. Modified MTSP-1 polypeptides can be dosed daily or weekly or less frequently, such as for example, monthly or less frequently, such as bi-monthly. In some instances a single systemic dose of the modified MTSP-1 polypeptide is administered. Multiple infusions of the modified MTSP-1 polypeptide over several hours are also considered. Modified MTSP-1 polypeptides can be delivered chronically, if needed, for example, the modified MTSP-1 polypeptides, such as the modified MTSP-1 polypeptides described herein, can be delivered on a daily basis or on another schedule to maintain an effective amount in the allograft recipient. Modified MTSP-1 polypeptides can be used to prolong allograft survival in a recipient, in particular, chronic survival of the allograft. PEGylated MTSP-1 polypeptides can be used to reduce immunogenicity.

3. Combination Therapies

MTSP-1 polypeptides provided herein can be used in combination with other existing drugs and therapeutic agents to treat diseases and conditions. Such treatments can be performed in conjunction with other anti-inflammatory drugs and/or therapeutic agents. Examples of anti-inflammatory drugs and agents useful for combination therapies include non-steroidal anti-inflammatory drugs (NSAIDs)

including salicylates, such as aspirin, traditional NSAIDs such as ibuprofen, naproxen, ketroprofen, nabumetone, piroxicam, diclofenac, or indomethacin, and Cox-2 selective inhibitors such as celecoxib (sold under the trademark Celebrex®) or Rotecoxin (sold under the trademark Vioxx®). Other compounds useful in combination therapies include antimetabolites such as methotrexate and leflunomide, corticosteroids or other steroids such as cortisone, dexamethasone, or prednisone, analgesics such as acetaminophen, aminosalicylates such as mesalamine, and cytotoxic agents such as azathioprine (sold under the trademark Imuran®), cyclophosphamide (sold under the trademark Cytoxan®), and cyclosporine A. Additional agents that can be used in combination therapies include biological response modifiers. Biological response modifiers can include pro-inflammatory cytokine inhibitors including inhibitors of TNF-alpha such as etanercept (sold under the trademark Enbrel®), infliximab (sold under the trademark Remicade®), or adalimumad (sold under the trademark Humira®), and inhibitors of IL-1 such as anakinra (sold under the trademark Kineret®). Biological response modifiers also can include anti-inflammatory cytokines such as IL-10, B cell targeting agents such as anti-CD20 antibodies (sold under the trademark Rituximab®), compounds targeting T antigens, adhesion molecule blockers, chemokines receptor antagonists, kinase inhibitors such as inhibitors to mitogen-activated protein (MAP) Kinase c-Jun N-terminal Kinase (JNK), or nuclear factor (NF)κB, and peroxisome proliferator-activated receptor-gamma (PPAR-γ) ligands. Additional agents that can be used in combination therapies include immunosuppressants. Immunosuppressants can include tacrolimus or FK-506; mycophenolic acid; calcineurin inhibitors (CNIs); CsA; sirolimus or other agents known to suppress the immune system.

MTSP-1 polypeptides provided herein also can be used in combination with agents that are administered to treat cardiovascular disease and/or administered during procedures to treat cardiovascular disease such as for example those described herein that contribute to inflammatory conditions associated with complement-mediated ischemia-reperfusion injury. For example, MTSP-1 polypeptides provided can be administered in combination with anti-coagulants. Examples of exemplary anti-coagulants include, but are not limited to, heparin, warfarin, acenocoumarol, phenindione, EDTA, citrate, oxalate, and direct thrombin inhibitors such as argatroban, lepirudin, bivalirudin, and ximelagatran.

MTSP-1 polypeptides provided herein also can be used in combination with agents that are administered to treat DGF. MTSP-1 polypeptides provided herein can, for example, be administered in combination with an immunosuppressive agent. Such combination is useful in prolonging allograft survival in a recipient, in particular, chronic survival of the allograft. In preferred embodiments, the combination is formulated and prepared such that it is suitable for chronic administration to the recipient of the allograft, for example, stable formulations are employed. In certain embodiments, the combination is formulated and prepared such that it is suitable for concurrent administration of the modified MTSP-1 polypeptides and the immunosuppressive drug to the recipient of the allograft. In certain embodiments, the combination is formulated and prepared such that it is suitable for sequential (in either order) administration of the modified MTSP-1 polypeptides and the immunosuppressive drug to the recipient of the allograft.

MTSP-1 polypeptides provided herein also can be used in combination with agents that are administered to treat macular degeneration. For example, modified MTSP-1 poly peptides can be administered with any one or more of ranibizumab (sold under the trade name Lucentis™); bevacizumab (sold under the trade name Avastin™); pegaptanib sodium (sold under the trade name Macugen™); aflibercept (sold under the trade name Eylea™); and verteporfin (sold under the trade name Visudyne™). MTSP-1 polypeptides provided herein also can be used in combination with an implantable telescope, laser treatment or laser photocoagulation, surgery, and/or photodynamice therapy, alone or in combination with the therapeutic verteporfin, to treat macular degeneration.

Additional agents, such as other complement inhibitors, can be used as anti-inflammatory drugs in combination therapy with modified MTSP-1 polypeptides as described herein. Examples of such other complement inhibitors include cobra venom factor (CVF), polyanionic molecules such as heparin, dextran sulphate, polyvinyl sulphate, polylysine, or suramin, natural molecules such as K-76COOH, Rosmarinic acid, or extract of the Chinese medicinal herb Ephedra, synthetic molecules such as afamastat mesilate (FUT-175), a synthetic inhibitor of C1s (C1s-INH-248), or an inhibitor against C1s and fD (BCX-1470), peptide inhibitors such as compstatin, antibody inhibitors of complement such as anti-C5 (N19-8), a humanized anti-C5 (h5G1.1), anti-C6, or anti-C8 antibodies, and soluble forms of membrane complement regulators such as soluble CR1 (sCR1), soluble DAF (sDAF), soluble MCP (sMCF), or soluble CD59 (sCD59) (Morgan et al., (2003) *Mol Immunol.* 40:159).

Pharmaceutical compositions containing a MTSP-1 polypeptides described herein can be used to treat any one or more inflammatory diseases or conditions mediated by complement activation. Also provided are combinations of a MTSP-1 polypeptides and another treatment or compound for treatment of an inflammatory disease or condition. The MTSP-1 polypeptides and the anti-inflammatory agent can be packaged as separate compositions for administration together or sequentially or intermittently. Alternatively, they can be provided as a single composition for administration or as two compositions for administration as a single composition. The combinations can be packaged as kits, optionally with additional reagents, instructions for use, vials and other containers, syringes and other items for use of the modified MTSP-1 polypeptides.

I. EXAMPLES

The following examples are included for illustrative purposes only and are not intended to limit the scope of the invention.

Example 1

Cloning and Expression of Modified MTSP-1 Polypeptides and Screening for Modified MTSP-1 Polypeptides that Cleave C3 in a Target Site A. Cloning and Mutagenesis of MTSP-1

A nucleic acid encoding amino acids 615-855 with the C122S replacement of the human MTSP-1 polypeptide set forth in SEQ ID NO: 1 was prepared. The construct included the pro-region, activation sequence, and protease domain, and contained residues 598 to the C-terminus of the sequence published by Takeuchi et al. (1999) *Proc. Natl. Acad. Sci. U.S.A.* 96:11054 and SEQ ID NO:1 (i.e., corresponding to residues 598 to 855 of the sequence of amino acids set forth in SEQ ID NO:1).

Modified MTSP-1 polypeptides were generated by Quikchange site directed mutagenesis (Stratagene) according to the manufacturer's instructions with specifically designed oligonucleotides that served as primers to incorporate designed mutations into the newly synthesized DNA. Briefly, a PCR sample reaction was set up containing the wild type MTSP-1 as a template and oligonucleotide primers designed to contain the desired mutation(s). Following PCR, each reaction product was digested with DpnI to remove dam methylated parental strands of DNA. The DNA was then transformed into E. coli XL-1 Blue Supercompetent cells (Stratagene) and plated on selective agar containing 50 µg/ml carbenicillin. Plasmid DNA was isolated from selected clones, and sequenced to verify incorporation of mutation(s) at the desired location(s) within the MTSP-1 gene and the absence of any additional, undesired mutations.

B. Preparation of MTSP-1 Polypeptides

1. Transformation

The protease domain of the wild-type and modified MTSP-1 polypeptides (both containing the C122S replacement) as detailed in Section A, above, were cloned into the pQE-80 expression vector (Qiagen) and the resulting constructs transformed into BL21 Gold (DE3) E. coli cells (Agilent Technologies, Catalog number: 230132). Approximately 50 µL of chemically competent BL21 Gold (DE3) cells were transformed with the appropriate plasmid DNA (typically approximately 5 ng of purified plasmid DNA or 5-10 µL of a ligation reaction mixture). Cells and DNA were incubated on ice for 30 minutes, heat shocked at 42° C. for 45 sec, and then incubated on ice for 2 minutes. 450 µL of room temperature Terrific Broth (TB media) (VWR International, Catalog number: 100219-866) were added, and the cells were grown in the TB media for 1 hour with shaking at 240 rpm at 37° C. 20 µL of solution containing the transformed cells were spread on a 2×YT medium+100 µg/mL carbenicillin plate from Teknova (Catalog number: Y4420) and incubated overnight at 37° C. Isolated colonies were then selected and used for plasmid preparations. The resulting plasmids were subjected to DNA sequencing to confirm the presence of the coding sequence for the desired MTSP-1 polypeptide.

2. Expression of MTSP-1 Polypeptides

Five hundred µl of an overnight culture of cells that had been transformed with a pQE-80 expression plasmid containing the coding sequence for the desired MTSP-1 polypeptide were added to 100 mL of Terrific Broth/Carbenicillin$_{100}$ containing 2.1 mL of Solution 1, 5.4 mL of Solution 2, and 107 µl of Solution 3 from Overnight Express™ Autoinduction System 1 in a 500 mL Erlenmeyer flask. The flask was placed into an Infors Multitron Shaker set at 210 rpm. The culture was grown (with shaking) overnight at 37° C. The following morning, 20 µl of 1M Isopropyl β-D-1-thiogalactopyranoside (IPTG) was added to the culture to induce expression of the MTSP-1 polypeptide, and the culture was grown at 37° C. with shaking for an additional 2 hours. This "induced culture" was collected in a 250 mL conical centrifuge bottle and spun at 3600 rpm for 10 min at 4° C. in an Allegra™ 6R centrifuge with a GH-3.8/GH-3.8A rotor. The resulting cell pellet was either stored at −20° C. or further processed immediately as described below.

3. Isolation of MTSP-1 Polypeptide Inclusion Bodies

The bacterial cell pellet from the 100 mL culture was resuspended in 60 ml BugBuster® extraction reagent (Merck Millipore, NC9591474) containing 60 rLysozyme™ (Sigma, Catalog number: L6876) by vortexing followed by shaking at 240 rpm for 1 hr at 37° C. to facilitate lysis of the bacteria. After bacterial lysis, insoluble material was pelleted by centrifugation at 3,600 rpm for 10 minutes at 4° C., and the supernatant was decanted. The resulting pellet was resuspended by homogenizing in 100 mL of 50 mM Tris pH 8.0 using a Power Gen 500 homogenizer (Fisher Scientific, 14-261-04P) with a 20×195 mm generator probe using 2×5 second pulses repeated until the pellet was well dispersed. The resuspended material was centrifuged at 3,600 rpm for 10 minutes at 4° C., supernatant decanted, and the pellet was allowed to air dry for 10 to 15 minutes. The pellet of inclusion bodies (IB) was weighed and stored at −20° C. until use.

4. Resuspension and Unfolding of Inclusion Bodies Containing MTSP-1 Polypeptides The insoluble MTSP-1 polypeptides were isolated from inclusion bodies and denatured in the presence of reducing agent. 4-5 grams of the D3 pellet were resuspended in 25 mL of 50 mM Tris, pH 8.0 by homogenization to form the D3 solution. 75 mL of unfolding buffer (6M GuHCl, 50 mM Tris pH 8.0, (Teknova, Catalog number: G0380)) was added to the D3 solution. The resulting D3 solution was agitated at 240 rpm at 37° C. for at least 1 hour, or until the inclusion bodies were fully dissolved.

5. Refolding of MTSP-1 Polypeptides

Five ml of the resuspended, denatured MTSP polypeptide solution described above was dripped slowly into ≥100 ml of Refolding Buffer (1.5 M Arginine, 50 mM Tris pH 7.5, 150 mM NaCl) at a dilution of 1:20 or greater (or approximately ≤100 µg protein/ml refolding buffer), with stirring. The protein solution in Refolding Buffer was incubated on a shaker at 150 rpm for 24 hours at room temperature to allow folding to take place.

The resulting protein solution was transferred to 12,000-14,000 Dalton molecular weight cutoff (MWCO) Spectra/Por® regenerated cellulose dialysis tubing (VWR) and dialyzed in 180 L of 25 mM Tris, pH 8.0 for at least 4 hours. The following day, the samples were transferred to a new tank of 180 L of 25 mM Tris, pH 8.0 and allowed to dialyze overnight. The following day, the samples were transferred to a third tank of 180 L of 25 mM Tris, pH 8.0 and dialyzed for at least 18 hours. Samples were dialyzed at least overnight, and for up to multiple days. Samples dialyzed for one day were incubated at room temperature and samples dialyzed for more than one day were incubated at 4° C. The ratio of total dialysis buffer volume to total sample volume was at least 100. Following dialysis, the protease samples were removed from the dialysis tubing and filtered using a 500 mL, 0.22 µm flask (Millipore), and the conductivity of the solution was measured. The conductivity of the solution was adjusted to prevent non-specific binding to the Benzamidine column during the activation step described below. The NaCl concentration was adjusted to approximately 0.5 M NaCl (e.g., 390 mL of 5 M NaCl was added to 3.9 L of dialyzed protein). The conductivity of the solution should be approximately 1.3 ms (/cm).

6. Activation of MTSP-1 Polypeptides

After filtration of the solution containing refolded MTSP-1 polypeptide, the NaCl concentration was adjusted to approximately 0.5 M by addition of 5M NaCl. Twenty mL of immobilized trypsin agarose beads were packed into an Econo-Pak disposable column (Bio-Rad; Catalog number 7321010) and the column was equilibrated with 200 mL (i.e., 10 column volumes) of Chromatography Solution Buffer A (25 mM Tris pH 8.0, 0.5M NaCl). The refolded MTSP-1 polypeptide solution (see above) was loaded on the column, and the flow throw containing the activated MTSP-1 polypeptide was collected. The flow through fractions that contained protein were combined and dialyzed overnight in 25 mM Tris buffer (pH=8.0) and buffer exchanged twice in 150 liters. The conductivity of the resulting, activated MTSP-1 polypeptide solution was confirmed to be less than 2 ms/cm, or adjusted appropriately with 25 mM Tris, pH=8.0.

7. Purification of MTSP-1 Polypeptides

The MTSP-1 polypeptides can be and have been purified according to the following steps:
1. Measure the conductivity of the activated sample using a SevenEasy Conductivity Meter. If the measurement is <3 ms/cm, then proceed to step 2 below. If the measurement is >3 ms/cm, dilute sample with Chromatography Solution Buffer A (25 mM Tris pH 8.0, 0.5M NaCl) until conductivity reaches <3 ms/cm.
2. Using an AKTAPURIFIER, load sample onto a 5 mL HiTrap Q HP cation exchange column pre-equilibrated with 5 column volumes (CV) of Chromatography Solution Buffer A at a flow rate of 8 mL/min.
3. Wash the column with 5 column volumes of Chromatography Solution Buffer A.
4. Elute with 15 column volumes of 0-50% NaCl gradient using Chromatography Solutions Buffer A/Buffer B at 5 mL/min. Collect 2 ml fractions.
5. The column is washed with 3 CV of Chromatography Solution Buffer B, and then re-equilibrated with 5 CV of Chromatography Solution Buffer A prior to loading of the next sample.
6. Active MTSP-1 is located by activity assay, where 5 µl of fraction is mixed with 50 µl of Assay Buffer containing 200 µM of an appropriate quenched fluorescence substrate (add QHAR QF substrate).
7. Read activity on a Molecular Devices M5 plate reader at 30° C. Set Excitation at 490 nm and Emission at 520 nm.
8. Concentrate the four most active fractions using a 15 mL Amicon Ultra 10K Centrifugal Filter.
9. Measure concentration by A280 using the Nanodrop Spectrophotometer. Continue concentrating until achieving an approximate final concentration of 200 µM.
10. To assess quality of purified product, load 2 µg/lane of sample in 2× Sample Buffer containing 2× NuPAGE Sample Reducing Agent on a 4-12% NuPAGE Novex Bis-Tris gel. Run the gel in 1×MES Running Buffer at 200V for 30 min. Visualize the gel by staining with Coomassie Blue followed by destaining.
11. Snap freeze the sample in liquid nitrogen and store at −80° C.

8. Endotoxin Removal from Purified MTSP-1 Polypeptides for Use in In Vivo Models Removal of high molecular weight Endotoxin was achieved by passing the sample through a 15 ml Amicon Ultra-15 Centrifugal Filter Unit 100K membrane (Fisher Scientific). The sample was filtered by spinning at 4000 RPM for 20 minutes. If sample had not passed through the filter after 20 minutes, the centrifugation step was repeated. Then, the sample was transferred to a clean falcon tube. To ensure complete removal of small molecular weight Endotoxin, the sample was passed over a 2 ml Cellufine ET clean S gravity column (Fisher Scientific). At least 24 hours prior to addition of the sample, the 2 ml Cellufine ET clean S column was prepared. 4 mL of Cellufine ET clean S slurry and 10 mL Endo-Free 20% Ethanol solution (Fisher Scientific) was added to the Econo-Pac Chromatography Gravity Column. The 20% EtOH solution was passed through the column, followed by 25 mL of 80% EtOH, 0.2N NaOH. The bottom of the gravity column was capped and the column was filled with 80% EtOH, 0.2N NaOH, covered and incubated at room temp for at least 16 hours. After at least 16 hours, the 80% EtOH, 0.2N NaOH was allowed to pass through the column. The column was rinsed with 25 mL endotoxin-free water and the water was allowed to pass through the column. Next, the column was equilibrated with 2×20 mL sterile endo-free phosphate buffered saline (PBS). The sample was then added to the column and the eluted sample was collected. The column was washed with 10 mL endo-free PBS to ensure that the sample had completely passed through the column.

Protein concentration, A280, was measured using a Nano-Drop® Spectrophotometer (NanoDrop) and use of a theoretical extinction coefficient of 2.012 mg/$A_{280}$. If necessary, active protein was concentrated using 15 mL Amicon Ultra-15 10K membrane Centrifugal Filter Units (Fischer Scientific) to approximately 2.5 mg/ml in citrate-buffered saline (20 mM Sodium Citrate pH 5.0, 50 mM NaCl). To assess the quality of the purified product, 2 µg of sample in 1×NuPAGE LDS Sample buffer (Invitrogen, Corp.) containing 2×NuPAGE sample reducing agent (Invitrogen) was loaded on a 12-well 4-12% NuPAGE Novex 4-12% Bis-Tris Gel (Invitrogen), and run in 1×NuPAGE MES SDS Running Buffer (Invitrogen) at 200 V for 30 minutes. The cell was stained with Coomassie Blue followed by destaining to visualize protein bands. Protein was snap-frozen in liquid nitrogen and stored at −80° C.

C. Selection and Identification of Modified MTSP-1 Polypeptides that Cleave C3 to Inactivate it Modified MTSP-1 polypeptides were identified by screening a library of modified MTSP-1 polypeptides against a modified serpin ATIII as described in detail in U.S. Pat. No. 8,211,428 (see, also U.S. Publication No. US-2014-0242062-A1, now U.S. Pat. No. 9,795,655). An inhibitory serpin, or fragment thereof, capable of forming a covalent acyl enzyme intermediate between the serpin and protease is used for screening. Generally, the serpin that is used is one that targets and regulates the wild type protease in vivo. Any serpin, however, that reacts with and irreversibly inhibits the target protease can be used as a "bait" for these selection experiments.

In the assay, a serpin modified by replacement of its reactive site loop (RSL) to include a target sequence (i.e., the target site in C3 for cleavage to inactive C3) captures modified proteases that cleave the target site to form stable complexes. The captured modified protease is then isolated/identified. For the MTSP-1 polypeptides, the "bait" serpin was ATIII that was modified by replacing the residues indicated below with QHARASHLG (residues 737-745 of C3, SEQ ID NO: 9), which is the targeted site for inactivation of human C3.

```
ATIII "bait" (SEQ ID NO: 692) with inserted
sequence QHARASHLG corresponding to the targeted
site of C3 (residues 737-745 of SEQ ID NO: 9):
         10         20         30         40
HGSPVDICTA KPRDIPMNPM CIYRSPEKKA TEDEGSEQKI 50         60         70         80
PEATNRRVWE LSKANSRFAT TFYQHLADSK NDNDNIFLSP 90        100        110        120
LSISTAFAMT KLGACNDTLQ QLMEVFKFDT ISEKTSDQIH 130        140        150        160
FFFAKLNCRL YRKANKSSKL VSANRLFGDK SLTFNETYQD
```

```
                  170         180         190         200
           ISELVYGAKL  QPLDFKENAE  QSRAAINKWV  SNKTEGRITD 210         220         230         240
           VIPSEAINEL  TVLVLVNTIY  FKGLWKSKFS  PENTRKELFY 250         260         270         280
           KADGESCSAS  MMYQEGKFRY  RRVAEGTQVL  ELPFKGDDIT 290         300         310         320
           MVLILPKPEK  SLAKVEKELT  PEVLQEWLDE  LEEMMLVVHM 330         340         350         360
           PRFRIEDGFS  LKEQLQDMGL  VDLFSPEKSK  LPGIVAEGRD 370         380         390         400
           DLYVSDAFHK  AFLEVNEEGS  EAAASTAVVQ  HARASHLGRV 410         420         430         440
           TFKANRPFLV  FIREVPLNTI  IFMGRVANPC  VKGGGSDYKD  DDDK
```

The mutations in the ATIII with reference to the position in SEQ ID NO: 692 are summarized as follows:

| | | | |
|---|---|---|---|
| RCL | QHARASHLG | 390 | 398 |
| C-Terminus | GGGSDYKDDDDK | 433 | 444 |
| Mutation | I390Q | 390 | 390 |
| Mutation | A391H | 391 | 391 |
| Mutation | G392A | 392 | 392 |
| Mutation | S394A | 394 | 394 |
| Mutation | L395S | 395 | 395 |
| Mutation | N396H | 396 | 396 |
| Mutation | P397L | 397 | 397 |
| Mutation | N398G | 398 | 398 |
| Flag Tag | DYKDDDDK | 437 | 444 |

In order to perform the selection for protease variants which are trapped by the QHAR-ASHLG modified ATIII bait, a library of MTSP variants was displayed on the surface of M13 bacteriophage, fused to the C-terminus of phage coat protein P3. Several MTSP libraries were designed by substituting the natural codons with NNK codons at positions in MTSP hypothesized to be important for substrate recognition and cleavage based on molecular modeling or were "second sphere" positions that contact mutated residues that were previously selected and proved to be advantageous. These positions corresponded to both prime side or non-prime side sites on MTSP, including positions 40, 41, 60b, 60g, 96-99 (plus insertions of 1 and 2 amino acids within the 96-99 region), 151, 175, 192, 217, and 224. To ensure sufficient representation for each variant in the phage library, the size of each constructed library (measured by CFUs generated of transformed library DNA) was significantly greater than the calculated diversity for all libraries that contained 5 or 6 randomized positions and comparable to the calculated diversity for libraries that contained 7 randomized positions. After construction of the MTSP phage libraries, 96 colonies from each library were sequenced to confirm mutation frequency and distribution and to assess the overall library quality. High quality libraries (i.e., those containing the expected frequency of mutations, no contamination, etc.) were then subjected to selection by incubating with the multiple concentrations of the biotinylated bait serpin for various lengths of time. The trapped biotinylated-MTSP-phage complex was captured on avidin coated plates, washed with 6M Guanidine hydrochloride to remove high affinity, non-covalent protease-serpin complexes, and then eluted with DTT. On some occasions a counterselection, using alpha 2-macroglobulin or naturally occurring serpins, such as ATIII was performed. Frequently, the selection and counterselection were performed simultaneously by incubating the library with both target serpin and counterselection serpin(s) in the same reaction. Typically, the counterselection serpin(s) would be present in molar excess over the selection serpin. Several rounds of selection were performed, then individually outgrown colonies were screened by enzyme assay for performance against a peptide corresponding to the target substrate. Colonies producing variants with high activity for cleavage of the target sequence were further characterized by DNA sequencing of their phagemid DNA to identify the identity of the mutations in the MTSP-1 coding sequence.

D. Modified MTSP-1 Polypeptides

Table 14 below sets forth modifications and the sequences of exemplary protease domains of modified MTSP-1 polypeptides that were generated and selected to inactivate C3, with the mutations indicated using numbering relative to the mature MTSP-1 polypeptide set forth in SEQ ID NO:1 (mature MTSP-1 numbering), and also chymotrypsin numbering (additional modifications are set forth in Table 15). While the SEQ ID NOs. reference protease domains, it is understood that the mutations can be included in mature modified MTSP-1 polypeptides, catalytically active portions thereof that contain the referenced modifications, and active forms and activated two chain forms.

The C122S replacement, or other conserved replacement for S, is included to eliminate dimerization of the protease and reduce the potential for formation of "inappropriate" disulfide bonds during the folding process; while advantageous, it is an optional mutation.

| Modified MTSP-1 Polypeptides | | |
|---|---|---|
| Mature MTSP-1 numbering | Chymotrypsin numbering | SEQ ID NO.* |
| I640R/F706T/InsE/T707G/F708L/C731S/G759N/Q783L/Q802E | I41R/F97T/Ins97aE/T98G/F99L/C122S/G151N/Q175L/Q192E | 21 |
| Q637H/I640A/D661V/F664R/Y666W/F706T/InsE/T707G/F708L/C731S/G759N/Q783L/Q802D | Q38H/I41A/D60bV/F60eR/Y60gW/F97T/ins97aE/T98G/F99L/C122S/G151N/Q175L/Q192D | 22 |
| Q637H/I640A/D661T/F664K/Y666W/F706T/InsE/T707G/F708L/C731S/G759N/Q783L/Q802D | Q38H/I41A/D60bT/F60eK/Y60gW/F97T/ins97aE/T98G/F99L/C122S/G151N/Q175L/Q192D | 23 |

-continued

Modified MTSP-1 Polypeptides

| Mature MTSP-1 numbering | Chymotrypsin numbering | SEQ ID NO.* |
|---|---|---|
| Q637H/I640S/D661T/F664S/Y666W/F706D/ InsV/T707P/F708L/C731S/G759H/Q783L/ Q802E | Q38H/I41S/D60bT/F60eS/Y60gW/F97D/ ins97aV/T98P/F99L/C122S/G151H/ Q175L/Q192E | 24 |
| Q637H/I640S/D661T/F664S/Y666W/F706D/ InsV/T707P/F708L/C731S/G759H/Q783L/ Q802D | Q38H/I41S/D60bT/F60eS/Y60gW/F97D/ ins97aV/T98P/F99L/C122S/G151H/ Q175L/Q192D | 25 |
| Q637H/I640A/D661T/F664K/Y666W/F706T/ InsE/T707G/F708L/C731S/G759H/Q783L/ Q802D | Q38H/I41A/D60bT/F60eK/Y60gW/F97T/ ins97aE/T98G/F99L/C122S/G151H/ Q175L/Q192D | 26 |
| Q637H/I640S/D661T/F664S/Y666W/F706D/ InsV/T707P/F708L/C731S/G759N/Q783L/ Q802D | Q38H/I41S/D60bT/F60eS/Y60gW/F97D/ ins97aV/T98P/F99L/C122S/G151N/ Q175L/Q192D | 27 |
| Q637H/I640A/D661V/F664R/Y666W/F706T/ InsE/T707P/F708L/C731S/G759H/Q783L/ Q802D | Q38H/I41A/D60bV/F60eR/Y60gW/F97T/ ins97aE/T98G/F99L/C122S/G151H/ Q175L/Q192D | 28 |
| Q637H/I640A/D661V/F664R/Y666W/D705I/ F706Y/InsN/T707G/F708L/C731S/G759N/ Q783L/Q802D | Q38H/I41A/D60bV/F60eR/Y60gW/D96I/ F97Y/ins97aN/T98G/F99L/C122S/ G151N/Q175L/Q192D | 29 |
| Q637H/I640S/D661T/F664S/Y666W/D705K/ F706D/InsA/T707P/F708L/C731S/G759H/ Q783L/Q802D | Q38H/I41S/D60bT/F60eS/Y60gW/D96K/ F97D/ins97aA/T98P/F99L/C122S/ G151H/Q175L/Q192D | 30 |
| Q637H/I640A/D661V/F664R/Y666W/D705P/ F706W/InsN/T707G/F708L/C731S/G759N/ Q783L/Q802E | Q38H/I41A/D60bV/F60eR/Y60gW/D96P/ F97W/ins97aN/T98G/F99L/C122S/ G151N/Q175L/Q192E | 31 |
| Q637H/I640A/D661V/F664R/Y666W/D705I/ F706N/T707G/F708L/C731S/G759N/Q783L/ Q802D | Q38H/I41A/D60bV/F60eR/Y60gW/ D96I/F97N/T98G/F99L/C122S/G151N/ Q175L/Q192D | 32 |
| Q637H/I640S/D661T/F664S/Y666W/D705Y/ F706/InsV/T707G/F708L/C731S/G759H/ Q783L/Q802D | Q38H/I41S/D60bT/F60eS/Y60gW/ D96Y/F97E/ins97aV/T98G/F99L/C122S/ G151H/Q175L/Q192D | 33 |
| Q637H/I640S/D661T/F664S/Y666W/D705L/ F706D/InsG/T707N/F708L/C731S/G759H/ Q783L/Q802E | Q38H/I41S/D60bT/F60eS/Y60gW/D96L/ F97D/ins97aG/T98N/F99L/C122S/ G151H/Q175L/Q192E | 34 |
| Q637H/I640S/D661T/F664S/Y666W/D705K/ F706G/InsV/T707P/F708L/C731S/G759H/ Q783L/Q802D | Q38H/I41S/D60bT/F60eS/Y60gW/D96K/ F97G/ins97aV/T98P/F99L/C122S/ G151H/Q175L/Q192D | 35 |
| Q637H/I640S/D661T/F664S/Y666W/D705V/ F706G/InsV/T707P/F708L/C731S/G759H/ Q783L/Q802D | Q38H/I41S/D60bT/F60eS/Y60gW/D96V/ F97G/ins97aV/T98P/F99L/C122S/ G151H/Q175L/Q192D | 36 |
| Q637H/I640S/D661T/F664S/Y666W/D705K/ F706D/InsA/T707P/F708L/C731S/G759N/ Q783L/Q802D | Q38H/I41S/D60bT/F60eS/Y60gW/D96K/ F97D/ins97aA/T98P/F99L/C122S/ G151N/Q175L/Q192D | 37 |
| Q637H/I640S/D661T/F664S/Y666W/F706G/ InsV/T707P/F708L/C731S/G759H/Q783L/ Q802D | Q38H/I41S/D60bT/F60eS/Y60gW/F97G/ ins97aV/T98P/F99L/C122S/G151H/ Q175L/Q192D | 38 |
| Q637H/I640S/D661T/F664S/Y666W/D705K/ InsV/T707P/F708L/C731S/G759H/Q783L/ Q802D | Q38H/I41S/D60bT/F60eS/Y60gW/D96K/ ins97aV/T98P/F99L/C122S/G151H/ Q175L/Q192D | 39 |
| Q637H/I640S/D661T/F664S/Y666W/D705K/ F706G/InsV/T707P/F708L/C731S/G759H/ Q783L | Q38H/I41S/D60bT/F60eS/Y60gW/D96K/ F97G/ins97aV/T98P/F99L/C122S/ G151H/Q175L | 40 |
| I640E/F708L/C731S/G759N/Q802T | I41E/F99L/C122S/G151N/Q192T | 41 |
| I640D/C731S/G759N/Q802T | I41D/C122S/G151N/Q192T | 42 |
| I640S/F708L/C731S/G759N/Q802V | I41S/F99L/C122S/G151N/Q192V | 43 |
| I640E/F708L/C731S/G759N/Q802T | I41E/F99L/C122S/G151N/Q192T | 44 |
| I640D/Y658F/D705E/F708L/C731S/G759N/ Q802T | I41D/Y59F/D96E/F99L/C122S/G151N/ Q192T | 45 |
| I640D/Y658F/C731S/G759N/Q802T | I41D/Y59F/C122S/G151N/Q192T | 46 |
| I640S/D661T/F664S/Y666W/D705K/F706G/ InsV/T707P/F708L/C731S/G759H/Q783L/ Q802D | I41S/D60bT/F60eS/Y60gW/D96K/F97G/ ins97aV/T98P/F99L/C122S/G151H/ Q175L/Q192D | 47 |
| Q637H/D661T/F664S/Y666W/D705K/F706G/ InsV/T707P/F708L/C731S/G759H/Q783L/ Q802D | Q38H/D60bT/F60eS/Y60gW/D96K/F97G/ ins97aV/T98P/F99L/C122S/G151H/ Q175L/Q192D | 48 |
| Q637H/I640S/F664S/Y666W/D705K/F706G/ InsV/T707P/F708L/C731S/G759H/Q783L/ Q802D | Q38H/I41S/F60eS/Y60gW/D96K/F97G/ ins97aV/T98P/F99L/C122S/G151H/ Q175L/Q192D | 49 |
| Q637H/I640S/D661T/Y666W/D705K/F706G/ InsV/T707P/F708L/C731S/G759H/Q783L/ Q802D | Q38H/I41S/D60bT/Y60gW/D96K/F97G/ ins97aV/T98P/F99L/C122S/G151H/ Q175L/Q192D | 50 |
| Q637H/I640S/D661T/F664S/D705K/F706G/ InsV/T707P/F708L/C731S/G759H/Q783L/ Q802D | Q38H/I41S/D60bT/F60eS/D96K/F97G/ ins97aV/T98P/F99L/C122S/G151H/ Q175L/Q192D | 51 |

Modified MTSP-1 Polypeptides

| Mature MTSP-1 numbering | Chymotrypsin numbering | SEQ ID NO.* |
|---|---|---|
| Q637H/I640S/D661T/F664S/Y666W/D705K/F706G/T707P/F708L/C731S/G759H/Q783L/Q802D | Q38H/I41S/D60bT/F60eS/Y60gW/D96K/F97G/T98P/F99L/C122S/G151H/Q175L/Q192D | 52 |
| Q637H/I640S/D661T/F664S/Y666W/D705K/F706G/InsV/F708L/C731S/G759H/Q783L/Q802D | Q38H/I41S/D60bT/F60eS/Y60gW/D96K/F97G/ins97aV/F99L/C122S/G151H/Q175L/Q192D | 53 |
| Q637H/I640S/D661T/F664S/Y666W/D705K/F706G/InsV/T707P/C731S/G759H/Q783L/Q802D | Q38H/I41S/D60bT/F60eS/Y60gW/D96K/F97G/ins97aV/T98P/C122S/G151H/Q175L/Q192D | 54 |
| Q637H/I640S/D661T/F664S/Y666W/D705K/F706G/InsV/T707P/F708L/C731S/Q783L/Q802D | Q38H/I41S/D60bT/F60eS/Y60gW/D96K/F97G/ins97aV/T98P/F99L/C122S/Q175L/Q192D | 55 |
| Q637H/I640S/D661T/F664S/Y666W/D705K/F706G/InsV/T707P/F708L/C731S/G759H/Q802D | Q38H/I41S/D60bT/F60eS/Y60gW/D96K/F97G/ins97aV/T98P/F99L/C122S/G151H/Q192D | 56 |
| Q637H/I640S/D705K/F706G/InsV/T707P/F708L/C731S/Q802D | Q38H/I41S/D96K/F97G/ins97aV/T98P/F99L/C122S/Q192D | 57 |
| I640S/D705K/F706G/InsV/T707P/F708L/C731S/Q783L/Q802D | I41S/D96K/F97G/ins97aV/T98P/F99L/C122S/Q175L/Q192D | 58 |
| Q637H/I640S/D705K/F706G/InsV/T707P/F708L/C731S/Q783L/Q802D | Q38H/I41S/D96K/F97G/ins97aV/T98P/F99L/C122S/Q175L/Q192D | 59 |
| I640S/D705K/F706G/InsV/T707P/F708L/C731S/Q802D | I41S/D96K/F97G/ins97aV/T98P/F99L/C122S/Q192D | 63 |
| Q637H/I640S/D705K/F706G/InsV/T707P/F708L/C731S/Q783L/Q802D | Q38H/I41S/D96K/F97G/ins97aV/T98P/F99L/C122S/Q175L/Q192D | 64 |
| Q637H/I640S/D661Y/D705K/F706G/InsV/T707P/F708L/C731S/Q802D/D828V | Q38H/I41S/D60bY/D96K/F97G/ins97aV/T98P/F99L/C122S/Q192D/D217V | 65 |
| I640S/D705K/F706G/InsV/T707P/F708L/C731S/Q802G/D828V | I41S/D96K/F97G/ins97aV/T98P/F99L/C122S/Q192G/D217V | 66 |
| I640S/D661Y/D705K/F706G/InsV/T707P/F708L/C731S/Q802D/D828V | I41S/D60bY/D96K/F97G/ins97aV/T98P/F99L/C122S/Q192D/D217V | 67 |
| I640S/D705M/F706G/InsV/T707P/F708L/C731S/Q802G/D828V | I41S/D96M/F97G/ins97aV/T98P/F99L/C122S/Q192G/D217V | 68 |
| I640S/D705K/F706G/InsV/T707P/F708L/C731S/Q802V/D828I | I41S/D96K/F97G/ins97aV/T98P/F99L/C122S/Q192V/D217I | 69 |
| I640S/D705K/F706G/InsV/T707P/F708L/C731S/Q802H | I41S/D96K/F97G/ins97aV/T98P/F99L/C122S/Q192H | 70 |
| I640S/D705K/F706G/InsV/T707P/F708L/C731S/Q802N/D828V | I41S/D96K/F97G/ins97aV/T98P/F99L/C122S/Q192N/D217V | 71 |
| I640S/D661Y/D705K/F706G/InsV/T707P/F708L/C731S/Q783L/Q802D | I41S/D60bY/D96K/F97G/ins97aV/T98P/F99L/C122S/Q175L/Q192D | 72 |
| Q637H/I640S/D705K/F706G/InsV/T707P/F708L/C731S/Q802G/D828V | Q38H/I41S/D96K/F97G/ins97aV/T98P/F99L/C122S/Q192G/D217V | 73 |
| I640S/D705K/F706G/InsV/T707P/F708L/C731S/Q783L/Q802V | I41S/D96K/F97G/ins97aV/T98P/F99L/C122S/Q175L/Q192V | 74 |
| I640S/P648S/D705K/F706G/InsV/T707P/F708L/C731S/Q802L/D828V | I41S/P49S/D96K/F97G/ins97aV/T98P/F99L/C122S/Q192G/D217V | 75 |
| I640S/D705K/F706G/InsV/T707P/F708L/C731S/Q783L/Q802N/D828V | I41S/D96K/F97G/ins97aV/T98P/F99L/C122S/Q175L/Q192N/D217V | 76 |
| I640T/F706G/F708L/C731S/G759N/Q783M/Q802G/D828L | I41T/F97W/F99L/C122S/G151N/Q175M/Q192G/D217L | 77 |
| I640G/F706G/F708L/C731S/Q783A/Q802T/D828V | I41G/F97L/F99L/C122S/Q175A/Q192T/D217V | 78 |
| I640G/F706V/F708L/C731S/G759Q/Q783M/Q802A/D828L | I41G/F97V/F99L/C122S/G151Q/Q175M/Q192A/D217L | 79 |
| I640G/F706I/F708L/C731S/G759L/Q783M/Q802S/D828V | I41G/F97I/F99L/C122S/G151L/Q175M/Q192S/D217V | 80 |
| I640G/F706S/F708L/C731S/G759N/Q783L/Q802G/D828I | I41G/F97S/F99L/C122S/G151N/Q175L/Q192G/D217I | 81 |

*SEQ ID of the protease domain containing the replacements

Example 2

In Vitro Cleavage of Complement Protein C3

The activity of the modified MTSP-1 polypeptides was determined by cleavage of the substrate complement protein, human C3, by measuring the amount of intact human C3 remaining after incubation with various concentrations of the protease for 1 hour at 37° C. In this assay, signal is generated in the presence of intact human C3, and is lost as the C3 is cleaved.

2 μM plasma purified human C3 (hC3; Complement Technologies; Tyler, Tex.) was incubated with the modified MTSP-1 polypeptides (0-250 nM) for 1 hour at 37° C. in buffer containing 50 mM Tris, pH 8.0, 50 mM NaCl, and 0.01% Tween-20. The activity of the modified MTSP-1 polypeptides was quenched by the addition of EGR-CMK (Haematologic Technologies, EGRCK-01) to a final concentration of 10 μM and the hC3/modified MTSP-1 polypeptide mixture was allowed to stand for 30 minutes at ambient temperature.

Residual levels of undigested human C3 were quantified using an Amplified Luminescent Proximity Homogeneous Assay Screen (AlphaScreen®; Perkin Elmer). α-mouse IgG-coated acceptor beads at 100 µg/mL (Perkin Elmer #6760606) were incubated with 5 nM mouse α-hC3a mAb (Abcam # ab11872-50) in 50 mM Tris, pH 8.0, 50 mM NaCl, 0.01% Tween-20 and 0.2% BSA to form the acceptor bead mixture. The acceptor bead mixture was shielded from light and placed on a rotating shaker for 30-60 minutes. The hC3/modified MTSP-1 polypeptide reaction mixtures (prepared above) were diluted 1600-fold into 50 mM Tris, pH 8.0, 50 mM NaCl, 0.01% Tween-20, 0.2% BSA and 4 µL aliquots were placed in duplicate wells of a 384-well Opti-plate (Perkin Elmer #6007299). 8 µL of a α-hC3 mAb/acceptor beads mixture was incubated with 8 µL of 25 nM biotinylated goat α-hC3 pAb (prepared using EZ-Link Sulfo-NHS-LC-Biotin kit from Thermo Scientific #21327 from the unbiotinylated version from Complement Technologies # A213). The plate was then shielded from light and incubated for 30 minutes at ambient temperature. After this incubation, 4 µL of 100 µg/mL streptavidin-coated donor beads (Perkin Elmer #6760606) were added to each well and incubated for 60 minutes, shielded from light. The alphascreen signal (Excitation=680 nm, Emission=570 nm) was then measured using an Envision 2104 Multilabel plate reader (Perkin Elmer). This signal (corresponding to the concentration of remaining hC3 ([hC3])) was plotted as a function of modified MTSP-1 polypeptide concentration ([Alterase]) and the data were fitted to the four parameter equation below to determine the concentration of modified MTSP-1 polypeptide (the 'alterase' concentration) required to cleave 50% of the available hC3 ($EC_{50}$), the Hill slope (Hill) as well as the maximum (Max) and minimum (Min) signals in the assay.

$$[hC3] = Min + \frac{Max - Min}{1 + \left(\frac{[Alterase]}{EC_{50}}\right)^{Hill}}$$

The cleavage of hC3 by modified MTSP-1 polypeptides with the sequence set forth in SEQ ID NO: 35 was measured independently a total of 46 times, using 9 different lots of the protease. The modified MTSP-1 polypeptide with the sequence set forth in SEQ ID NO: 35 cleaved complement protein C3 with a lower $EC_{50}$ than the reference MTSP-1 polypeptide set forth in SEQ ID NO: 4, which has an $EC_{50}$=13.9 nM (n=235; SD=4.1). The average $EC_{50}$ value for the modified MTSP-1 polypeptide with the sequence set forth in SEQ ID NO: 35 was determined to be 6.9 nM (n=46, SD=2.6). C3 cleavage reactions were performed 1-12 times for all other modified MTSP-1 polypeptides listed in Table 15.

Table 15 sets forth exemplary modifications, and the $EC_{50}$ for polypeptides, as set forth in the Sequence Listing, that contain these modifications. It is understood that the sequence listing sets forth the protease domain, but that these same mutations can be included in full-length modified MTSP-1, and various forms thereof, and catalytically active forms thereof. As set forth, all include the replacement of the free cysteine C122S; the replacement reduces aggregation, and can be optional.

TABLE 15 hC3 Cleavage with Modified MTSP-1 Polypeptides

| SEQ ID NO.* | Chymotrypsin Numbering MODIFICATIONS | $EC_{50}$ (nM) |
|---|---|---|
| 4 | C122S | 13.9 |
| 23 | Q38H/I41A/D60bT/F60eK/Y60gW/F97T/ins97aE/T98G/F99L/C122S/G151N/Q175L/Q192D | 14.4 |
| 24 | Q38H/I41S/D60bT/F60eS/Y60gW/F97D/ins97aV/T98P/F99L/C122S/G151H/Q175L/Q192E | 6.68 |
| 32 | Q38H/I41A/D60bV/F60eR/Y60gW/D961/F97N/T98G/F99L/C122S/G151N/Q175L/Q192D | 2.87 |
| 35 | Q38H/I41S/D60bT/F60eS/Y60gW/D96K/ins97aV/F97G/T98P/F99L/C122S/G151H/Q175L/Q192D | 6.86 |
| 36 | Q38H/I41S/D60bT/F60eS/Y60gW/D96V/F97G/ins97aV/T98P/F99L/C122S/G151H/Q175L/Q192D | 2.85 |
| 37 | Q38H/I41S/D60bT/F60eS/Y60gW/D96K/F97D/ins97aA/T98P/F99L/C122S/G151N/Q175L/Q192D | 5.92 |
| 38 | Q38H/I41S/D60bT/F60eS/Y60gW/F97G/ins97aV/T98P/F99L/C122S/G151H/Q175L/Q192D | 169 |
| 39 | Q38H/I41S/D60bT/F60eS/Y60gW/D96K/ins97aV/T98P/F99L/C122S/G151H/Q175L/Q192D | 12 |
| 40 | Q38H/I41S/D60bT/F60eS/Y60gW/D96K/F97G/ins97aV/T98P/F99L/C122S/G151H/Q175L | 1.45 |
| 42 | I41D/C122S/G151N/Q192T | 85.2 |
| 43 | I41S/F99L/C122S/G151N/Q192V | 34.4 |
| 44 | I41E/F99L/C122S/G151N/Q192T | 124 |
| 45 | I41D/Y59F/D96E/F99L/C122S/G151N/Q192T | 54.9 |
| 46 | I41D/Y59F/C122S/G151N/Q192T | 56.7 |
| 47 | I41S/D60bT/F60eS/Y60gW/D96K/F97G/ins97aV/T98P/F99L/C122S/G151H/Q175L/Q192D | 17.1 |
| 48 | Q38H/D60bT/F60eS/Y60gW/D96K/F97G/ins97aV/T98P/F99L/C122S/G151H/Q175L/Q192D | 215 |
| 49 | Q38H/I41S/F60eS/Y60gW/D96K/F97G/ins97aV/T98P/F99L/C122S/G151H/Q175L/Q192D | 13.1 |
| 50 | Q38H/I41S/D60bT/Y60gW/D96K/F97G/ins97aV/T98P/F99L/C122S/G151H/Q175L/Q192D | 8.64 |
| 51 | Q38H/I41S/D60bT/F60eS/D96K/F97G/ins97aV/T98P/F99L/C122S/G151H/Q175L/Q192D | 22.2 |

TABLE 15-continued hC3 Cleavage with Modified MTSP-1 Polypeptides

| SEQ ID NO.* | Chymotrypsin Numbering MODIFICATIONS | $EC_{50}$ (nM) |
|---|---|---|
| 52 | Q38H/I41S/D60bT/F60eS/Y60gW/D96K/F97G/T98P/F99L/C122S/G151H/Q175L/Q192D | 7.88 |
| 53 | Q38H/I41S/D60bT/F60eS/Y60gW/D96K/F97G/ins97aV/F99L/C122S/G151H/Q175L/Q192D | 9.83 |
| 54 | Q38H/I41S/D60bT/F60eS/Y60gW/D96K/F97G/ins97aV/T98P/C122S/G151H/Q175L/Q192D | 18.3 |
| 55 | Q38H/I41S/D60bT/F60eS/Y60gW/D96K/F97G/ins97aV/T98P/F99L/C122S/Q175L/Q192D | 5.25 |
| 56 | Q38H/I41S/D60bT/F60eS/Y60gW/D96K/F97G/ins97aV/T98P/F99L/C122S/G151H/Q192D | 19.9 |
| 57 | Q38H/I41S/D96K/F97G/ins97aV/T98P/F99L/C122S/Q192D | 108 |
| 58 | I41S/D96K/F97G/ins97aV/T98P/F99L/C122S/Q175L/Q192D | 68.6 |
| 59 | Q38H/I41S/D96K/F97G/ins97aV/T98P/F99L/C122S/Q175L/Q192D | 22 |
| 77 | I41T/F97W/F99L/C122S/G151N/Q175M/Q192G/D217L | 12.1 |
| 78 | I41G/F97L/F99L/C122S/Q175A/Q192T/D217V | 7.75 |
| 79 | I41G/F97V/F99L/C122S/G151Q/Q175M/Q192A/D217L | 9.74 |
| 80 | I41G/F971/F99L/C122S/G151L/Q175M/Q192S/D217V | 2.84 |
| 81 | I41G/F97S/F99L/C122S/G151N/Q175L/Q192G/D2171 | 6.84 |
| 154 | F97E/F99L/C122S/D217I/K224N | 6.33 |
| 155 | C122S/G193A | 44.7 |
| 156 | C122S/G193E | 119 |
| 157 | D96_F97de1insWYY/T98P/F99L/C122S | 22.6 |
| 158 | F97D/F99L/C122S/Q192G | 78.1 |
| 159 | H40R/I41H/F97D/F99L/C122S/Q192G | 35.4 |
| 160 | C122S/G151N/G193A | 85.7 |
| 161 | H40R/I41H/C122S/G151N | 59.6 |
| 162 | H40R/I41H/F97D/C122S/G151N | 110 |
| 163 | H40R/I41H/F97E/C122S | 51.7 |
| 164 | F97T/ins97aE/T98G/F99L/C122S/Q175L/Q192E | 259 |
| 165 | H40R/I41H/Y60gL/F97D/F99L/C122S/G151N/Q175M/D2171/K224S | 7.41 |
| 166 | H40R/I41H/F97D/F99L/C122S/G151D/Q192G | 1530 |
| 167 | H40R/I41H/F97D/F99L/Q192G | 24.1 |
| 168 | H40R/I41H/Y60gH/F97D/F99L/C122S/G151N/Q175A/Q192H/D2171/K224R | 19.8 |
| 169 | H40R/I41H/Y60gF/F97D/F99L/C122S/Q192G/D217M/K224R | 38 |
| 170 | H40R/I41H/Y60gF/F97D/F99L/C122S/Q192G/D217R/K224A | 25.9 |
| 171 | H40R/I41H/F97D/F99L/C122S/Q175L/Q192G/D217K/K224A | 14.1 |
| 172 | H40R/I41H/F97D/F99L/C122S/Q175M/Q192G/D217V/K224Y | 2.76 |
| 173 | H40R/I41H/F97D/F99L/C122S/Q175K/Q192G/D2171/K224H | 19.4 |
| 174 | H40R/I41H/F97D/F99L/C122S/Q175M/Q192G/D217S | 24.4 |
| 175 | H40R/I41H/Y60gF/F97D/F99L/C122S/Q175M/Q192G/D217W/K224R | 9.92 |
| 176 | H40R/I41H/Y60gN/F97D/F99L/C122S/G151N/Q175K/Q192S/D217S/K224L | 187 |
| 177 | H40R/I41H/Y60gH/F97D/F99L/C122S/Q175M/Q192G/D2171/K224L | 3.72 |
| 178 | H40K/I41L/Y60gF/F97D/F99L/C122S/G151N/Q175R | 237 |
| 179 | H40R/I41H/Y60gL/F97D/F99L/C122S/G151N | 54.9 |
| 180 | H40K/I41M/Y60gG/F97D/F99L/C122S/G151N/Q175R/Q192R/D217V/K224S | 509 |
| 181 | H40K/I41M/Y60gF/F97D/F99L/C122S/G151N/Q175L/Q192D | 589 |
| 182 | H40R/I41H/F97D/C122S/G151N/Q175M/Q192A/D217S/K224R | 470 |
| 183 | H40R/I41H/Y60gH/F97D/F99L/C122S/Q175M/Q192G/D2171/K224R | 7.94 |
| 184 | H40R/I41H/F97D/F99L/C122S/G151D/Q175M/Q192G/D217V | 70.8 |
| 185 | H40R/I41H/F97D/F99L/C122S/G151N/Q175M/Q192A/D217N/K224R | 563 |
| 186 | H40R/I41H/F97D/F99L/C122S/G151N/Q175L/Q192A/D217N/K224R | 540 |
| 187 | H40K/I41M/F97D/F99L/C122S/G151N/Q175M/Q192D/D217N/K224R | 9.74 |
| 188 | H40K/I41M/F97D/F99L/C122S/G151N/Q175L/Q192A/D217N/K224R | 1290 |
| 189 | H40R/I41H/F97D/F99L/C122S/Q175M/Q192D/D217N/K224R | 9990 |
| 190 | H40R/I41H/F97D/F99L/C122S/Q175M/D217N/K224R | 103 |
| 191 | H40K/I41M/F97D/F99L/C122S/Q175M/Q192D/D217N/K224R | 9.64 |
| 192 | H40K/I41M/F97D/F99L/C122S/G151N/Q175M/Q192A/D217N/K224R | 1230 |
| 193 | H40K/I41M/F97D/F99L/C122S/Q175M/D217N/K224R | 144 |
| 194 | H40R/I41H/F97T/ins97aE/T98G/F99L/C122S/Q175L/Q192E | 5860 |
| 195 | H40R/I41H/F97T/ins97aE/T98G/F99L/C122S/Q175L/Q192G | 46 |
| 196 | H40R/I41H/F97E/ins97aE/T98G/F99L/C122S/Q175L/Q192G | 82.4 |
| 197 | H40R/I41H/F97D/F99L/C122S/G151N/Q192H | 179 |
| 198 | H40R/I41H/F97D/F99L/C122S/G151N/L153R | 59.9 |
| 199 | H40R/I41H/F97D/C122S/G151N/L153R/V202M | 103 |
| 200 | H40R/I41H/F97D/F99L/C122S/G151N/Q192H/P232S | 262 |
| 201 | H40R/I41H/F97D/ins97aE/T98G/F99L/C122S/Q175L/Q192G | 39.7 |
| 202 | H40R/I41H/F97D/C122S/G151N/L153R | 126 |
| 203 | H40K/I41M/F99L/C122S/T150A/G151R/Q192G | 110 |
| 204 | H40R/I41H/F97D/C122S/G133D/G151N | 60.4 |
| 205 | I41R/F99L/C122S/Q192G | 53.8 |
| 206 | H40R/I41H/F99L/C122S/G151K/Q192G | 1520 |
| 207 | I41R/ins97aE/F97T/T98G/F99L/C122S/G151E/Q175L/Q192E | 126 |

TABLE 15-continued hC3 Cleavage with Modified MTSP-1 Polypeptides

| SEQ ID NO.* | Chymotrypsin Numbering MODIFICATIONS | $EC_{50}$ (nM) |
|---|---|---|
| 208 | K86R/K110R/C122S/K134R/K157R/K224R/K239R | 17.3 |
| 209 | H40R/I41H/K86R/F97D/K110R/C122S/K134R/G151N/K157R/K224R/K239R | 304 |
| 210 | K86R/F97T/ins97aE/T98G/F99L/K110R/C122S/K134R/K157R/Q175L/Q192E/K224R/K239R | 253 |
| 211 | H40R/I41H/F97D/F99L/C122S/Q175R/Q192G/D217H/K224S | 45.2 |
| 212 | H40R/I41H/F97D/F99L/C122S/Q192G/D2171/K224S | 19.3 |
| 213 | H40R/I41H/F97D/F99L/C122S/Q192G/D217K/K224A | 23.4 |
| 214 | H40R/I41H/F97D/F99L/C122S/Q175R/Q192G/D217E/K224R | 31.2 |
| 215 | H40R/I41H/F97D/C122S/Q175R/Q192G/D2171/K224Q | 93.1 |
| 216 | H40P/I41R/F99L/C122S/Q192G | 62.4 |
| 217 | H40P/I41R/F99L/C122S/G151K/Q192G | 96.1 |
| 218 | H40R/I41H/F99L/C122S/G151E/Q192G | 829 |
| 219 | I41R/ins97aE/F97T/T98G/F99L/C122S/G151D/Q175L/Q192E | 163 |
| 220 | I41R/ins97aE/F97T/T98G/F99L/C122S/G151D/Q175T/Q192E | 743 |
| 221 | I41R/ins97aE/F97T/T98G/F99L/C122S/G151D/Q175T/Q192D | 1620 |
| 222 | I41R/ins97aE/F97T/T98G/F99L/C122S/G151E/Q175T/Q192D | 1770 |
| 223 | H40P/I41R/ins97aE/F97T/T98G/F99L/C122S/Q175L/Q192E | 442 |
| 224 | H40P/I41R/ins97aE/F97T/T98G/F99L/C122S/G151D/Q175L/Q192E | 212 |
| 225 | I41R/ins97aE/F97T/T98G/F99L/C122S/G151N/Q175L/Q192E | 311 |
| 226 | I41R/ins97aE/F97T/T98G/F99L/C122S/G151N/Q175L/Q192D | 622 |
| 227 | I41R/ins97aE/F97T/T98G/F99L/C122S/G151N/Q175T/Q192E | 1410 |
| 228 | I41R/ins97aE/F97T/T98G/F99L/C122S/G151N/Q175T/Q192D | 9990 |
| 229 | I41R/ins97aE/F97T/T98G/F99L/C122S/Q175L/Q192E | 523 |
| 230 | H40P/I41R/F99L/C122S/G151E/Q192G | 153 |
| 231 | I41R/F97T/ins97aE/T98G/F99L/C122S/G151E/Q175T/Q192E | 363 |
| 232 | I41R/F97T/ins97aE/T98G/F99L/C122S/G151N/Q175S/Q192E | 267 |
| 233 | I41R/F97T/ins97aE/T98G/F99L/C122S/G151N/Q1751/Q192E | 1030 |
| 234 | H40R/I41H/Y60gF/F97D/F99L/C122S/Q175K/Q192G/D217R/K224Q | 93.4 |
| 235 | H40R/I41H/F97D/F99L/C122S/Q175L/Q192G/D217Q/K224R | 14.9 |
| 236 | H40R/I41H/F97D/F99L/C122S/G151N/Q192N/D217L/K224R | 346 |
| 237 | H40R/I41H/F97D/F99L/C122S/G151N/Q192H/D217K/K224A | 137 |
| 238 | ins97aV/F97D/T98P/F99L/C122S/Q192G | 53.5 |
| 239 | F97N/ins97aT/T98Y/F99N/C122S | 184 |
| 240 | F97M/ins97aD/T98D/F99L/C122S/Q192T | 151 |
| 241 | ins97aV/F97Q/T98P/F99L/C122S/Q175F/Q192D | 248 |
| 242 | ins97aD/F97T/T98S/F99L/C122S/Q192E/D217Y/K224R | 5000 |
| 243 | ins97aN/F97H/T98D/F99L/C122S/Q192E/D217Q/K224S | 2750 |
| 244 | F97Q/ins97aT/T98M/C122S/Q192E/D217R/K224L | 2450 |
| 245 | ins97aD/F97Q/T98G/F99L/C122S/Q175L/Q192E/D217F/K224S | 5560 |
| 246 | ins97aD/F97G/T98N/F99L/C122S/Q192E/D217Y/K224R | 9870 |
| 247 | ins97aE/F97Y/T98S/F99L/C122S/Q192T/D217Q/K224R | 249 |
| 248 | ins97aG/F97N/T98D/F99L/C122S/Q192E/D217H/K224A | 2790 |
| 249 | ins97aA/F97G/T98N/F99L/C122S/Q175M/Q192T/K224A | 200 |
| 250 | I41R/ins97aE/F97T/T98G/F99L/C122S/G151N/Q175S/Q192D | 2080 |
| 251 | I41R/F97T/ins97aE/T98G/F99L/C122S/G151N/Q1751/Q192D | 8370 |
| 252 | I41R/F97T/ins97aE/T98G/F99L/C122S/G151D/Q1751/Q192E | 2070 |
| 253 | I41R/ins97aE/F97T/T98G/F99L/C122S/G151D/Q1751/Q192D | 1750 |
| 254 | S90T/D96A/ins97aE/F97T/T98G/F99L/C122S/Q175L/Q192D | 280 |
| 255 | Y59F/ins97aE/F97T/T98G/F99L/C122S/Q175L/Q192E | 341 |
| 256 | ins97aE/F97T/T98G/F99L/C122S/Q175L/Q192E/Q209L | 383 |
| 257 | Y59F/D96V/ins97aE/F97T/T98G/F99L/C122S/Q175L/Q192E | 293 |
| 258 | D96V/ins97aE/F97T/T98G/F99L/C122S/Q175L/Q192D | 258 |
| 259 | I41R/ins97aE/F97T/T98G/F99L/C122S/G151S/Q175L/Q192E | 274 |
| 260 | E24K/ins97aE/F97T/T98G/F99L/C122S/A152S/Q175L/Q192D | 291 |
| 261 | ins97aE/F97T/T98G/F99L/C122S/L153Q/Q175L/Q192D | 332 |
| 262 | ins97aE/F97T/T98G/F99L/C122S/1136M/L155M/N170D/Q175L/Q192E | 429 |
| 263 | I41R/ins97aE/F97T/T98G/F99L/A112V/C122S/Q175L/Q192E | 288 |
| 264 | Y59F/F97T/ins97aE/T98G/F99L/C122S/Q175L/Q192D | 289 |
| 265 | Y59F/G60dS/R84H/ins97aE/F97T/T98G/F99L/C122S/Q175L/Q192E/V212I | 102 |
| 266 | Y59F/ins97aE/F97T/T98G/F99L/C122S/L153Q/Q175L/Q192E | 237 |
| 267 | I41R/Y59F/ins97aE/F97T/T98G/F99L/C122S/Q175L/Q192D | 288 |
| 268 | I41R/Y59F/G60dS/R84H/ins97aE/F97T/T98G/F99L/C122S/Q175L/Q192E/V2121 | 143 |
| 269 | I41R/Y59F/ins97aE/F97T/T98G/F99L/C122S/L153Q/Q175L/Q192E | 253 |
| 270 | I41R/F97W/F99L/C122S/G151N/Q192G | 97.3 |
| 271 | F97D/ins97aV/T98P/F99L/C122S/G151N/Q192G | 87 |
| 272 | I41D/ins97aE/F97T/T98G/F99L/C122S/Q175L/Q192E | 157 |
| 273 | I41D/ins97aE/F97T/T98G/F99L/C122S/G151N/Q175L/Q192E | 148 |
| 274 | Q38E/H40R/I41H/F97D/F99L/C122S/Q192G | 30.9 |
| 275 | H40R/I41H/F97D/F99L/Q175R/Q192G/D217E/K224R | 21.9 |
| 276 | I41R/ins97aV/F97D/T98P/F99L/C122S/G151N/Q192G | 232 |
| 277 | ins97aV/F97D/T98P/F99L/C122S/Q175L/Q192E | 158 |
| 278 | I41R/ins97aV/F97D/T98P/F99L/C122S/G151N/Q175L/Q192E | 187 |

TABLE 15-continued hC3 Cleavage with Modified MTSP-1 Polypeptides

| SEQ ID NO.* | Chymotrypsin Numbering MODIFICATIONS | $EC_{50}$ (nM) |
|---|---|---|
| 279 | Q38E/H40R/I41H/D60bE/F97D/F99L/C122S/Q192G | 28.1 |
| 280 | Q38E/H40R/I41H/D60bN/F97D/F99L/C122S/Q192G | 39.5 |
| 281 | Q38E/H40R/I41H/D60bK/F97D/F99L/C122S/Q175L/Q192G | 15.3 |
| 282 | Q38E/H40R/I41H/D60bN/F60eT/F97D/F99L/C122S/Q175L/Q192G | 9.42 |
| 283 | Q38R/I41S/D60bH/F60eV/F97T/ins97aE/T98G/F99L/C122S/Q175L/Q192E | 35.2 |
| 284 | Q38G/H40R/I41H/D60bK/F97D/F99L/C122S/Q175L/Q192G | 20.6 |
| 285 | I41D/ins97aE/F97T/T98G/F99L/C122S/G151N/Q175L/Q192E/Q209L | 103 |
| 286 | Q38G/H40R/I41H/D60bN/F97D/F99L/C122S/Q175L/Q192G | 0.867 |
| 287 | Q38R/I41S/D60bH/F60eV/ins97aE/F97T/T98G/F99L/C122S/G151N/Q175L/Q192E | 22.5 |
| 288 | H40R/I41H/F97D/ins97aV/T98P/F99L/C122S/Q175R/Q192G/D217E/K224R | 65.8 |
| 289 | Q38H/I41S/D60bA/F60eV/Y60gF/F97T/ins97aE/T98G/F99L/C122S/Q175L/Q192T | 7.46 |
| 290 | Q38E/I41S/D60bH/F60e1/F97T/ins97aE/T98G/F99L/C122S/Q175L/Q192V | 10.4 |
| 291 | Q38R/I41S/D60bH/F60e1/ins97aE/F97T/T98G/F99L/C122S/Q175L/Q192E | 27.3 |
| 292 | Q38E/I41S/D60bV/F60eK/F97T/ins97aE/T98G/F99L/C122S/Q175L/Q1921 | 20.4 |
| 293 | Q38R/I41E/ins97aE/F97T/T98G/F99L/C122S/Q175L/Q192T | 63.3 |
| 294 | Q38H/I41A/D60bV/F60eR/Y60gW/ins97aE/F97T/T98G/F99L/C122S/Q175L/Q192D | 2.37 |
| 295 | Q38H/I41A/D60bA/F60eR/F97T/ins97aE/T98G/F99L/C122S/Q175L/Q192E | 12 |
| 296 | F97D/ins97aV/T98P/F99L/C122S/G151N/Q175L/Q192E | 194 |
| 297 | ins97aV/F97D/T98P/F99L/C122S/G151N/Q175L/Q192G | 38.5 |
| 298 | Q38G/H40R/I41H/D60bN/F60eT/F97D/F99L/C122S/Q175L/Q192G | 11.9 |
| 299 | Q38G/H40R/I41H/D60bK/F60eT/F97D/F99L/C122S/Q175L/Q192G | 21.3 |
| 300 | Q38E/H40R/I41H/D60bK/F60eT/F97D/F99L/C122S/Q175L/Q192G | 16.6 |
| 301 | Q38H/I41S/D60bA/F60eV/Y60gF/ins97aE/F97T/T98G/F99L/C122S/G151N/Q175L/Q192T | 14.2 |
| 302 | Q38E/I41S/D60bH/F60e1/ins97aE/F97T/T98G/F99L/C122S/G151N/Q175L/Q192V | 11.5 |
| 303 | Q38R/I41S/D60bH/F60e1/ins97aE/F97T/T98G/F99L/C122S/G151N/Q175L/Q192E | 32.9 |
| 304 | Q38E/I41S/D60bV/F60eK/ins97aE/F97T/T98G/F99L/C122S/G151N/Q175L/Q192I | 19.1 |
| 305 | Q38R/I41E/ins97aE/F97T/T98G/F99L/C122S/G151N/Q175L/Q192T | 105 |
| 306 | Q38H/I41A/D60bV/F60eR/Y60gW/ins97aE/F97T/T98G/F99L/C122S/G151N/Q175L/Q192D | 7.74 |
| 307 | Q38H/I41A/D60bA/F60eR/ins97aE/F97T/T98G/F99L/C122S/G151N/Q175L/Q192E | 14.2 |
| 308 | Q38H/I41S/D60bT/F60eS/ins97aV/F97D/T98P/F99L/C122S/G151H/Q175L/Q192E | 29.8 |
| 309 | Q38H/I41S/D60bV/F60eQ/Y60gF/ins97aE/F97T/T98G/F99L/C122S/Q175L/Q192I | 5.95 |
| 310 | Q38H/I41A/D60bV/F60e1/ins97aE/F97T/T98G/F99L/C122S/Q175L/Q192E | 7.64 |
| 311 | Q38H/I41A/D60bV/F60eT/Y60gW/ins97aE/F97T/T98G/F99L/C122S/Q175L/Q192E | 1.39 |
| 312 | Q38H/I41A/F60eA/Y60gW/ins97aE/F97T/T98G/F99L/C122S/Q175L/Q192E | 5.93 |
| 313 | Q38H/I41A/D60bE/F60eH/Y60gW/ins97aE/F97T/T98G/F99L/C122S/Q175L/Q192D | 5.38 |
| 314 | Q38H/I41A/D60bT/F60eK/Y60gW/ins97aE/F97T/T98G/F99L/C122S/Q175L/Q192D | 3.82 |
| 315 | Q38H/I41A/D60bT/F60eH/Y60gW/ins97aE/F97T/T98G/F99L/C122S/Q175L/Q192D | 2.28 |
| 316 | Q38H/I41S/D60bS/F60eR/Y60gW/F97T/ins97aE/T98G/F99L/C122S/Q175L/Q192E | 8.35 |
| 317 | Q38H/I41S/D60bT/F60eS/F97D/ins97aV/T98P/F99L/C122S/G151H/Q175L/Q192D | 45.4 |
| 318 | Q38R/I41T/ins97aE/F97T/T98G/F99L/C122S/G151N/Q175L/Q192G | 30.6 |
| 319 | Q38S/I41S/F60eR/F97T/ins97aE/T98G/F99L/C122S/G151N/Q175L/Q192S | 6.26 |
| 320 | Q38H/I41T/D60bV/F60eQ/F97T/ins97aE/T98G/F99L/C122S/Q175L/Q192G | 4.93 |
| 321 | Q38G/H40R/I41H/D60bH/F60eK/F97T/ins97aE/T98G/F99L/C122S/Q175L/V183A/Q192G | 27.7 |
| 322 | Q38H/I41A/F97T/ins97aE/T98G/F99L/C122S/Q175L/Q192G | 3.9 |
| 323 | Q38L/I41T/D60bR/F60eL/Y60gM/F97T/ins97aE/T98G/F99L/C122S/G151N/Q175L/Q192G | 23.7 |

TABLE 15-continued

| hC3 Cleavage with Modified MTSP-1 Polypeptides | | |
|---|---|---|
| SEQ ID NO.* | Chymotrypsin Numbering MODIFICATIONS | $EC_{50}$ (nM) |
| 324 | Q38F/I41S/D60bF/F60eR/Y60gF/F97T/ins97aE/T98G/F99L/C122S/G151N/Q175L/Q192V | 1.96 |
| 325 | Q38V/I41S/D60bT/F60eT/F97D/ins97aV/T98P/F99L/C122S/G151N/Q175H/Q192S | 18.5 |
| 326 | Q38W/I41A/ins97aV/F97D/T98P/F99L/C122S/G151T/Q175S/Q192D | 68 |
| 327 | Q38T/I41S/D60bV/F60eR/ins97aV/F97D/T98P/F99L/C122S/G151N/Q175R/Q192V | 15.7 |
| 328 | Q38H/I41S/D60bT/F60eS/ins97aV/F97D/T98P/F99L/C122S/G151H/Q175A/Q192D | 67.8 |
| 329 | Q38H/I41S/D60bT/F60eT/F97D/ins97aV/T98P/F99L/C122S/G151N/Q175L/Q192V | 5.08 |
| 330 | Q38Y/I41A/D60bL/F60eQ/ins97aV/F97D/T98P/F99L/C122S/G151N/Q175M/Q192A | 1.53 |
| 331 | Q38L/I41T/D60bA/F60eL/ins97aV/F97D/T98P/F99L/C122S/G151H/Q175M/Q192T | 20.2 |
| 332 | Q38R/I41S/D60bY/F60eD/ins97aV/F97D/T98P/F99L/C122S/G151N/Q175M/Q192A | 3.22 |
| 333 | Q38W/I41S/D60bG/F60e1/F97D/ins97aV/T98P/F99L/C122S/G151N/Q175A/Q192D | 43.1 |
| 334 | Q38T/I41S/D60bG/F60eM/ins97aV/F97D/T98P/F99L/C122S/G151N/Q175S/Q192S | 28.8 |
| 335 | I41T/D60bW/F60eH/F97D/ins97aV/T98P/F99L/C122S/G151N/Q175L/Q192G | 3.1 |
| 336 | Q38D/I41S/D60bT/F60eR/ins97aV/F97D/T98P/F99L/C122S/G151K/Q175S/Q192V | 48.1 |
| 337 | Q38H/I41S/D60bF/F60eV/F97D/ins97aV/T98P/F99L/C122S/G151N/Q175L/Q192A | 1.57 |
| 338 | Q38L/I41A/D60bH/F60eT/ins97aV/F97D/T98P/F99L/C122S/G151Q/Q175A/Q192G | 5.73 |
| 339 | Q38H/I41A/D60bE/F60eH/Y60gW/F97T/ins97aE/T98G/F99L/C122S/G151N/Q175L/Q192D | 8.28 |
| 340 | Q38H/I41A/D60bV/F60e1/Y60gW/F97T/ins97aE/T98G/F99L/C122S/G151N/Q175L/Q192D | 2.91 |
| 341 | Q38E/I41S/D60bV/F60eK/Y60gW/F97T/ins97aE/T98G/F99L/C122S/G151N/Q175L/Q192D | 12.1 |
| 342 | Q38H/I41S/D60bT/F60eS/Y60gW/ins97aV/F97D/T98P/F99L/C122S/G151H/Q175L/Q192D | 12.6 |
| 343 | Q38H/I41S/D60bT/F60eS/Y60gW/F97D/ins97aV/T98P/F99L/C122S/G151H/Q175A/Q192D | 22.6 |
| 344 | Q38H/I41A/D60bV/F60eR/ins97aE/F97T/T98G/F99L/C122S/G151N/Q175L/Q192D | 6.06 |
| 345 | Q38H/I41A/D60bT/F60eH/Y60gW/F97T/ins97aE/T98G/F99L/C122S/G151N/Q175L/Q192D | 6.95 |
| 346 | D60bY/F97T/ins97aE/T98G/F99L/C122S/Q175L/Q192G | 4.1 |
| 347 | I41T/D60bY/F97T/ins97aE/T98G/F99L/C122S/Q175L/Q192G | 3.88 |
| 348 | Q38E/I41S/D60bT/F60eR/F97T/ins97aE/T98G/F99L/C122S/Q175L/Q192V | 32.7 |
| 349 | Q38H/I41A/D60bK/F60eK/Y60gW/F97T/ins97aE/T98G/F99L/C122S/Q175L/Q192D | 22.3 |
| 350 | Q38H/I41S/D60bA/F60eV/ins97aE/F97T/T98G/F99L/C122S/Q175L/Q192E/Q209L | 16.9 |
| 351 | Q38H/I41A/D60bT/F60eR/F97T/ins97aE/T98G/F99L/C122S/Q175L/Q192V | 6.54 |
| 352 | Q38K/I41S/F97T/ins97aE/T98G/F99L/C122S/Q175L/Q192V | 43 |
| 353 | Q38F/I41A/D60bT/F60eG/Y60gW/ins97aE/F97T/T98G/F99L/C122S/Q175L/Q192E | 1.25 |
| 354 | Q38H/I41A/F60eH/Y60gW/ins97aE/F97T/T98G/F99L/C122S/Q175L/Q192A | 3.09 |
| 355 | Q38H/I41A/D60bT/F60eK/Y60gW/F97T/ins97aE/T98G/F99L/C122S/Q175L/Q192A | 2.71 |
| 356 | Q38H/I41A/D60bV/F60eA/Y60gW/F97T/ins97aE/T98G/F99L/C122S/Q175L/Q192V | 1.57 |
| 357 | Q38E/I41V/D60bF/F60eK/Y60gF/F97T/ins97aE/T98G/F99L/C122S/Q175L/Q192G | 14.2 |
| 358 | Q38H/H40P/I41A/F60eQ/Y60gW/F97T/ins97aE/T98G/F99L/C122S/Q175L/Q192D | 5.04 |
| 359 | Q38R/I41V/D60bV/F60eV/Y60gF/ins97aE/F97T/T98G/F99L/C122S/Q175L/Q192G | 18.3 |
| 360 | Q38L/H40P/I41T/D60bV/F60eH/Y60gL/ins97aE/F97T/T98G/F99L/C122S/Q175L/Q192A | 6.47 |
| 361 | Q38H/I41A/D60bV/F60eH/ins97aE/F97T/T98G/F99L/C122S/Q175L/Q192D | 5.31 |
| 362 | Q38H/I41S/D60bA/F60eV/ins97aE/F97T/T98G/F99L/C122S/Q175L/Q192V | 10.9 |

TABLE 15-continued hC3 Cleavage with Modified MTSP-1 Polypeptides

| SEQ ID NO.* | Chymotrypsin Numbering MODIFICATIONS | $EC_{50}$ (nM) |
|---|---|---|
| 363 | Q38R/I41T/D60bH/ins97aE/F97T/T98G/F99L/C122S/Q175L/Q192G | 26.2 |
| 364 | Q38H/I41S/D60bT/F60eR/ins97aE/F97T/T98G/F99L/C122S/Q175L/Q192E | 15.4 |
| 365 | Q38K/I41T/ins97aE/F97T/T98G/F99L/C122S/Q175L/Q192A | 37.8 |
| 366 | Q38H/I41A/D60bT/F60eK/ins97aE/F97T/T98G/F99L/C122S/Q175L/Q192E | 14.6 |
| 367 | Q38L/I41T/D60bV/F60eH/Y60gL/ins97aE/F97T/T98G/F99L/C122S/Q175L/Q192S | 13.1 |
| 368 | ins97aA/F97G/T98L/C122S/Q175M/Q192A/D217I/K224R | 0.866 |
| 369 | Q38H/I41A/D60bY/F60eT/ins97aE/F97T/T98G/F99L/C122S/Q175L/Q192D | 4.77 |
| 370 | ins97aY/F97H/F99L/C122S/Q175M/Q192A/D217V | 5.72 |
| 371 | ins97aL/F97Q/T98G/F99L/C122S/Q175M/Q192S/D217I | 6.67 |
| 372 | ins97aY/F97G/T98V/C122S/Q175M/Q192S/D217V | 2.42 |
| 373 | Q38Y/I41S/D60bR/F60eE/Y60gF/ins97aE/F97T/T98G/F99L/C122S/Q175L/Q192V | 25 |
| 374 | Q38H/I41S/D60bT/F60eS/ins97aV/F97D/T98P/F99L/C122S/G151H/Q175L/Q192V | 20.2 |
| 375 | Q38H/I41S/D60bT/F60eS/Y60gW/ins97aV/F97D/T98P/F99L/C122S/G151H/Q175L/Q192V | 7.43 |
| 376 | Q38H/I41S/D60bT/F60eS/Y60gW/ins97aV/F97D/T98P/F99L/C122S/G151N/Q175A/Q192D | 22.5 |
| 377 | Q38H/I41S/D60bT/F60eS/Y60gW/ins97aV/F97D/T98P/F99L/C122S/G151N/Q175L/Q192E | 6.78 |
| 378 | Q38H/I41A/D60bE/F60eH/Y60gW/ins97aE/F97T/T98G/F99L/C122S/G151H/Q175L/Q192D | 13.8 |
| 379 | Q38H/I41A/D60bT/F60eK/Y60gW/ins97aE/F97T/T98G/F99L/C122S/G151H/Q175L/Q192D | 10.6 |
| 380 | Q38H/I41A/D60bV/F60eI/Y60gW/ins97aE/F97T/T98G/F99L/C122S/G151H/Q175L/Q192D | 6.42 |
| 381 | Q38E/I41S/D60bV/F60eK/Y60gW/ins97aE/F97T/T98G/F99L/C122S/G151H/Q175L/Q192D | 22.9 |
| 382 | Q38H/I41S/L52M/D60bG/ins97aV/F97D/T98P/F99L/M117K/C122S/I136L/Q192G/D217A | 22 |
| 383 | Q38E/I41A/D60bH/ins97aV/F97D/T98P/F99L/C122S/Q192G/Q209L/D217H | 10.2 |
| 384 | I41S/D60bT/F93L/ins97aV/F97D/T98P/F99L/C122S/Q192G/D217H | 27.7 |
| 385 | I41T/D60bH/ins97aV/F97D/T98P/F99L/C122S/Q192G/D217I | 4.52 |
| 386 | Q38H/I41S/D60bS/ins97aV/F97D/T98P/F99L/M117L/C122S/I136T/Q192G/D217I | 2.43 |
| 387 | Q38R/I41T/D60bT/ins97aV/F97D/T98P/F99L/C122S/I136V/Q192G/D217N/L233Q | 39.8 |
| 388 | Q38H/I41A/D60bW/ins97aV/F97D/T98P/F99L/C122S/I136M/Q192G/D217N | 3.06 |
| 389 | Q38H/I41S/P49Q/D60bS/F93L/ins97aV/F97D/T98P/F99L/C122S/Q192G/D217Q | 48.3 |
| 390 | Q38H/I41S/D60bT/ins97aV/F97D/T98P/F99L/C122S/I136V/Q192G/D217S | 22.2 |
| 391 | Q38H/I41S/D60bS/F93L/D96Y/ins97aV/F97D/T98P/F99L/C122S/I136F/Q192G/D217V | 9.56 |
| 392 | Q38H/I41T/D60bH/ins97aV/F97D/T98P/F99L/C122S/I136F/L153P/Q192G/D217Y | 25.5 |
| 393 | Q38H/I41S/D60bT/F93L/ins97aV/F97D/T98P/F99L/S115N/C122S/Q192V/F208L/D217Q | 45.8 |
| 394 | Q38K/I41T/D60bY/ins97aV/F97D/T98P/F99L/C122S/I136T/Q192G/F208V/D217R | 19.5 |
| 395 | Q38H/I41S/D60bS/ins97aV/F97D/T98P/F99L/C122S/I136V/Q192G/D217V | 7.05 |
| 396 | Q38H/I41S/D60bG/ins97aV/F97D/T98P/F99L/M117T/C122S/N164D/Q192G/D217E | 10.3 |
| 397 | Q38K/I41S/D60bV/ins97aV/F97D/T98P/F99L/M117T/C122S/Q145E/Q175L/Q192G | 11.8 |
| 398 | Q38H/I41S/D60bT/F60eT/Y60gW/ins97aV/F97D/T98P/F99L/C122S/G151H/Q175L/Q192V | 5.52 |
| 399 | Q38H/I41S/D60bT/F60eS/Y60gW/ins97aV/F97D/T98P/F99L/C122S/G151N/Q175L/Q192D | 15.4 |
| 400 | Q38H/I41A/D60bV/F60eR/Y60gW/ins97aE/F97T/T98G/F99L/C122S/G151H/Q175L/Q192D | 5.93 |
| 401 | Q38H/I41S/L52M/D60bH/D96V/ins97aV/F97D/T98P/F99L/C122S/T150A/Q192G/Q209L/D217T | 16.9 |
| 402 | I41S/D60bS/D96V/ins97aV/F97D/T98P/F99L/C122S/Q192G/F208L/D217N | 52.4 |
| 403 | Q38H/I41S/D60bT/S90T/F97D/ins97aV/T98P/F99L/C122S/S127N/I136F/Q192G/D217Q | 21.2 |
| 404 | Q38H/I41S/D60bT/F93S/ins97aV/F97D/T98P/F99L/C122S/I136L/Q192G/D217A | 37 |

TABLE 15-continued hC3 Cleavage with Modified MTSP-1 Polypeptides

| SEQ ID NO.* | Chymotrypsin Numbering MODIFICATIONS | EC$_{50}$ (nM) |
|---|---|---|
| 405 | I41S/D60bH/ins97aV/F97D/T98P/F99L/C122S/I136V/Q192G/D217N | 20.6 |
| 406 | L33M/Q38H/I41A/D60bA/ins97aV/F97D/T98P/F99L/C122S/Q192G/D217N | 50 |
| 407 | Q38H/I41S/D60bY/D96Y/ins97aV/F97D/T98P/F99L/L106M/C122S/I136M/Q192G/Q209L/D217T | 1.97 |
| 408 | Q38H/I41A/D60bV/F60eR/Y60gW/D96I/ins97aN/F97Y/T98G/F99L/C122S/G151N/Q175L/Q192D | 2.23 |
| 409 | Q38H/I41S/D60bT/F60eS/Y60gW/D96K/ins97aA/F97D/T98P/F99L/C122S/G151H/Q175L/Q192D | 7.09 |
| 410 | Q38H/I41T/D60bV/F60eR/Y60gW/D96I/ins97aN/F97Y/T98G/F99L/C122S/G151N/Q175L/Q192D | 9.75 |
| 411 | Q38H/I41A/D60bV/F60eR/Y60gW/D96Y/ins97a1/F97E/T98N/F99M/C122S/G151N/Q175L/Q192V | 4.36 |
| 412 | Q38H/I41A/D60bV/F60eR/Y60gW/D96S/ins97aR/F97A/T98S/F99L/C122S/G151N/Q175L/Q192T | 2.07 |
| 413 | Q38H/I41A/D60bV/F60eR/Y60gW/D96P/ins97aN/F97W/T98G/F99L/C122S/G151N/Q175L/Q192E | 1.51 |
| 414 | Q38H/I41S/D60bT/F60eS/Y60gW/F97D/F99L/C122S/G151H/Q175L/Q192D | 5.53 |
| 415 | Q38H/I41S/D60bT/F60eS/Y60gW/D96Y/ins97aV/F97E/T98G/F99L/C122S/G151H/Q175L/Q192D | 4.62 |
| 416 | Q38H/I41S/D60bA/Y60gG/ins97aV/F97D/T98P/F99L/C122S/H143T/G151N/Q175L/Q192A | 4.22 |
| 417 | Q38H/I41S/D60bT/F60eH/Y60gF/ins97aV/F97D/T98P/F99L/C122S/H143R/G151N/Q175L/Q192S | 21 |
| 418 | Q38H/I41S/D60bS/F60eQ/Y60gin/ins97aV/F97D/T98P/F99L/C122S/H143R/G151N/Q175L/Q192T | 12.9 |
| 419 | Q38H/I41S/D60bF/F60eT/ins97aV/F97D/T98P/F99L/C122S/H143Q/G151N/Q175L/Q192G | 3.07 |
| 420 | Q38H/I41S/D60bF/F60eQ/Y60gF/ins97aV/F97D/T98P/F99L/C122S/H143A/G151N/Q175L/Q192A | 4.58 |
| 421 | Q38H/I41S/D60bT/F60eT/ins97aV/F97D/T98P/F99L/C122S/H143Q/G151Q/Q175L/Q192G | 6.69 |
| 422 | Q38H/I41S/D60bQ/F60eQ/F97D/ins97aV/T98P/F99L/C122S/H143Q/G151Q/Q175L/Q192G | 8.5 |
| 423 | Q38H/I41S/D60bS/F60eQ/ins97aV/F97D/T98P/F99L/C122S/H143A/G151N/Q175L/Q192G | 26.3 |
| 424 | Q38H/I41A/D60bV/F60eR/Y60gW/D96Q/F97E/ins97aD/T98S/F99L/C122S/G151N/Q175L/Q192R | 4.6 |
| 425 | Q38H/I41S/D60bT/F60eS/Y60gW/D96F/F97D/ins97aE/T98S/F99L/C122S/G151H/Q175L/Q192A | 1.17 |
| 426 | Q38H/I41S/D60bT/F60eS/Y60gW/D96L/ins97aG/F97D/T98N/F99L/C122S/G151H/Q175L/Q192E | 1.59 |
| 427 | Q38H/I41S/D60bT/F60eS/Y60gW/D96K/ins97aV/F97G/T98P/F99L/C122S/G151H/Q175L/Q192D | 6.86 |
| 428 | Q38H/I41A/D60bV/F60eR/Y60gW/D96I/ins97aN/F97Y/T98G/F99L/C122S/G151H/Q175L/Q192D | 1.57 |
| 429 | Q38H/I41A/D60bV/F60eR/Y60gW/D96I/F97N/T98G/F99L/C122S/G151H/Q175L/Q192D | 2.52 |
| 430 | Q38H/I41S/D60bT/F60eS/Y60gW/F97D/F99L/C122S/G151N/Q175L/Q192D | 4.9 |
| 431 | Q38H/I41S/D60bT/F60eS/Y60gW/D96Y/ins97aV/F97E/T98G/F99L/C122S/G151N/Q175L/Q192D | 4.13 |
| 432 | Q38H/I41A/D60bV/F60eR/Y60gW/D96P/ins97aN/F97W/T98G/F99L/C122S/G151H/Q175L/Q192E | 1.11 |
| 433 | Q38H/I41A/D60bV/F60eR/Y60gW/D96P/ins97aN/F97W/T98G/F99L/C122S/G151N/Q175L/Q192D | 2.54 |
| 434 | Q38H/I41A/D60bV/F60eR/Y60gW/D96P/ins97aN/F97W/T98G/F99L/C122S/G151H/Q175L/Q192D | 1.83 |
| 435 | Q38H/I41A/D60bV/F60eR/Y60gW/F97D/F99L/C122S/G151H/Q175L/Q192D | 3.72 |
| 436 | Q38H/I41S/D60bT/F60eS/Y60gW/D96I/F97N/T98G/F99L/C122S/G151N/Q175L/Q192D | 3.04 |
| 437 | Q38H/I41A/D60bV/F60eR/Y60gW/F97D/F99L/C122S/G151N/Q175L/Q192D | 7.04 |
| 438 | I41S/D60bT/F60eS/Y60gW/ins97aV/F97D/T98P/F99L/C122S/G151H/Q175L/Q192E | 6.33 |
| 439 | Q38H/D60bT/F60eS/Y60gW/ins97aV/F97D/T98P/F99L/C122S/G151H/Q175L/Q192E | 66.7 |
| 440 | Q38H/I41S/F60eS/Y60gW/ins97aV/F97D/T98P/F99L/C122S/G151H/Q175L/Q192E | 3.83 |
| 441 | Q38H/I41S/D60bT/F60eS/Y60gW/ins97aV/T98P/F99L/C122S/G151H/Q175L/Q192E | 3.19 |
| 442 | Q38H/I41S/D60bT/F60eS/Y60gW/F97D/T98P/F99L/C122S/G151H/Q175L/Q192E | 25.7 |

TABLE 15-continued

| hC3 Cleavage with Modified MTSP-1 Polypeptides | | |
|---|---|---|
| SEQ ID NO.* | Chymotrypsin Numbering MODIFICATIONS | $EC_{50}$ (nM) |
| 443 | Q38H/I41S/D60bT/F60eS/Y60gW/ins97aV/F97D/F99L/C122S/G151H/Q175L/Q192E | 7.82 |
| 444 | Q38H/I41S/D60bT/F60eS/Y60gW/ins97aV/F97D/T98P/C122S/G151H/Q175L/Q192E | 11.5 |
| 445 | Q38H/I41S/D60bT/F60eS/Y60gW/ins97aV/F97D/T98P/F99L/C122S/Q175L/Q192E | 4.86 |
| 446 | Q38H/I41S/D60bT/F60eS/Y60gW/F97D/ins97aV/T98P/F99L/C122S/G151H/Q192E | 11.9 |
| 447 | Q38H/I41S/D60bT/F60eS/Y60gW/ins97aV/F97D/T98P/F99L/C122S/G151H/Q175L | 1.31 |
| 448 | Q38H/I41S/D60bT/F60eS/Y60gW/F97D/ins97aA/T98P/F99L/C122S/G151H/Q175L/Q192E | 4.07 |
| 49 | Q38H/I41S/D60bT/Y60gW/ins97aV/F97D/T98P/F99L/C122S/G151H/Q175L/Q192E | 10.4 |
| 450 | Q38H/I41S/D60bT/F60eG/Y60gW/D96V/F97N/T98G/F99L/C122S/G151N/Q175L/Q192D | 4.47 |
| 451 | Q38K/I41G/F60eG/Y60gW/D96P/F97N/T98G/F99L/C122S/G151N/Q175L/Q192D | 62.7 |
| 452 | Q38Y/I41E/D60bS/F60eV/Y60gF/D96W/F97N/T98G/F99L/C122S/G151N/Q175L/Q192D | 227 |
| 453 | Q38H/I41S/D60bT/F60eG/D96Y/F97N/T98G/F99L/C122S/G151N/Q175L/Q192D | 9.56 |
| 454 | Q38V/I41G/F60eG/Y60gW/D96P/F97N/T98G/F99L/C122S/G151N/Q175L/Q192D | 27.4 |
| 455 | Q38Y/I41A/D60bT/F60eG/Y60gW/D96V/F97N/T98G/F99L/C122S/G151H/Q175L/Q192D | 5.06 |
| 456 | Q38H/I41S/D60bT/F60eG/D96P/F97N/T98G/F99L/C122S/G151Q/G175L/Q192D | 34.2 |
| 457 | Q38K/I41G/D60bT/F60eG/Y60gW/D96P/F97N/T98G/F99L/C122S/G151N/Q175L/Q192D | 27.4 |
| 458 | Q38K/I41G/D60bT/F60eG/Y60gW/D96L/F97N/T98G/F99L/C122S/G151N/Q175L/Q192D | 12.5 |
| 459 | Q38E/I41S/D60bV/F60eK/Y60gW/D96P/F97N/T98G/F99L/C122S/G151N/Q175L/Q192D | 45.9 |
| 460 | Q38E/I41S/D60bW/F60eG/D96M/F97N/T98G/F99L/C122S/G151N/Q175L/Q192D | 22.3 |
| 461 | Q38M/I41S/F60eH/Y60gW/D96Y/F97N/T98G/F99L/C122S/G151N/Q175L/Q192D | 21.6 |
| 462 | Q38H/I41A/D60bV/F60eR/Y60gW/D96F/F97D/ins97aE/T98G/F99M/C122S/G151N/Q175L/Q192R | 13.1 |
| 463 | Q38H/I41A/D60bV/F60eR/Y60gW/D96F/F97E/ins97aT/T98G/F99M/C122S/G151N/Q175L/Q192G | 16.9 |
| 464 | Q38H/I41A/D60bV/F60eR/Y60gW/D96F/F97E/ins97aS/T98G/F99M/C122S/G151N/Q175L/Q192G | 21.3 |
| 465 | Q38H/I41A/D60bV/F60eR/Y60gW/D96W/F97D/ins97aD/T98G/F99L/C122S/G151N/Q175L/Q192G | 5.28 |
| 466 | Q38H/I41A/D60bV/F60eR/Y60gW/D96F/F97Y/ins97aE/T98G/F99M/C122S/G151N/Q175L/Q192R | 7.16 |
| 467 | Q38H/I41A/D60bV/F60eR/Y60gW/D96W/F97D/ins97aT/T98G/F99L/C122S/G151N/Q175L/Q192G | 4.9 |
| 468 | Q38H/I41S/D60bT/F60eK/Y60gF/D96M/F97N/T98G/F99L/C122S/G151N/Q175L/Q192D | 20.6 |
| 469 | Q38H/I41A/D60bV/F60eR/Y60gW/D96F/F97S/ins97aH/T98G/F99L/C122S/G151N/Q175L/Q192G | 3.14 |
| 470 | Q38H/I41A/D60bV/F60eR/Y60gW/D96F/F97Y/ins97aN/T98G/F99M/C122S/G151N/Q175L/Q192G | 3.76 |
| 471 | Q38H/I41S/D60bT/F60eS/Y60gW/D96F/F97S/ins97aD/T98G/F99L/C122S/G151H/Q175L/Q192D | 5.17 |
| 472 | Q38H/I41S/D60bT/F60eS/Y60gW/D96F/F97Y/ins97aD/T98G/F99L/C122S/G151H/Q175L/Q192D | 3.13 |
| 473 | Q38H/I41S/D60bT/F60eS/Y60gW/D96Y/F97N/ins97aE/T98S/F99L/C122S/G151H/Q175L/Q192D | 4.53 |
| 474 | Q38H/I41S/D60bT/F60eS/Y60gW/D96Y/F97R/ins97aD/T98G/F99L/C122S/G151H/Q175L/Q192D | 5.71 |
| 475 | Q38H/I41A/D60bT/F60eK/Y60gF/F97T/ins97aE/T98G/F99L/C122S/H143R/G151N/Q175L/Q192V | 24.5 |
| 476 | Q38Y/I41S/D60bV/F60eR/Y60gF/D96M/F97N/T98G/F99L/C122S/G151N/Q175L/Q192D | 5.25 |
| 477 | Q38E/I41S/D60bV/F60eK/Y60gW/D96M/F97N/T98G/F99L/C122S/G151N/Q175L/Q192D | 19.1 |
| 478 | Q38Y/I41S/D60bT/F60eR/Y60gW/D96M/F97N/T98G/F99L/C122S/G151N/Q175L/Q192D | 5.12 |
| 479 | Q38H/I41S/F60eT/Y60gW/D96M/F97N/T98G/F99L/C122S/G151N/Q175L/Q192D | 35.7 |

TABLE 15-continued hC3 Cleavage with Modified MTSP-1 Polypeptides

| SEQ ID NO.* | Chymotrypsin Numbering MODIFICATIONS | EC$_{50}$ (nM) |
|---|---|---|
| 480 | Q38H/I41S/D60bT/F60eK/D96V/F97N/T98G/F99L/C122S/G151N/Q175L/Q192D | 13.3 |
| 481 | I41S/D60bT/F60eR/Y60gW/D96M/F97N/T98G/F99L/C122S/G151N/Q175L/Q192D | 9.47 |
| 482 | Q38Y/D60bT/F60eR/Y60gW/D96M/F97N/T98G/F99L/C122S/G151N/Q175L/Q192D | 47.7 |
| 483 | Q38Y/I41S/F60eR/Y60gW/D96M/F97N/T98G/F99L/C122S/G151N/Q175L/Q192D | 10.4 |
| 484 | Q38Y/I41S/D60bT/Y60gW/D96M/F97N/T98G/F99L/C122S/G151N/Q175L/Q192D | 3.08 |
| 485 | Q38Y/I41S/D60bT/F60eR/D96M/F97N/T98G/F99L/C122S/G151N/Q175L/Q192D | 16.4 |
| 486 | Q38Y/I41S/D60bT/F60eR/Y60gW/F97N/T98G/F99L/C122S/G151N/Q175L/Q192D | 15.9 |
| 487 | Q38Y/I41S/D60bT/F60eR/Y60gW/D96M/T98G/F99L/C122S/G151N/Q175L/Q192D | 3.27 |
| 488 | Q38Y/I41S/D60bT/F60eR/Y60gW/D96M/F97N/F99L/C122S/G151N/Q175L/Q192D | 10.8 |
| 489 | Q38Y/I41S/D60bT/F60eR/Y60gW/D96M/F97N/T98G/C122S/G151N/Q175L/Q192D | 33.6 |
| 490 | Q38Y/I41S/D60bT/F60eR/Y60gW/D96M/F97N/T98G/F99L/C122S/G151N/Q192D | 56.7 |
| 491 | Q38Y/I41S/D60bT/F60eR/Y60gW/D96M/F97N/T98G/F99L/C122S/G151N/Q175L | 1.08 |
| 492 | Q38Y/I41S/D60bT/F60eR/Y60gW/D96M/F97N/T98G/F99L/C122S/75L/Q192DQ1 | 3.75 |
| 493 | Q38H/I41S/D60bT/F60eS/Y60gW/D96K/F97G/ins97aV/T98P/F99L/M117K/C122S/G151H/Q175L/Q192D | 4.75 |
| 494 | L36Q/Q38H/I41S/D60bT/F60eS/Y60gW/D96K/F97G/ins97aV/T98P/F99L/C122S/G151H/Q175L/Q192D | 5.49 |
| 495 | Q38H/I41S/D60bT/F60eS/Y60gW/D96K/F97G/ins97aV/T98P/F99L/C122S/T150S/G151H/Q175L/Q192D/Q209L | 2.88 |
| 496 | Q38H/I41S/D60bT/F60eS/Y60gW/D96K/F97G/ins97aA/T98P/F99L/C122S/G151H/Q175L/Q192D | 1.43 |
| 497 | I41G/F97A/F99L/C122S/G151H/Q175L/Q192G/D217L | 47.8 |
| 498 | I41G/F97S/F99L/C122S/G151N/Q175I/Q192T/D217T | 84.4 |
| 499 | I41R/F97A/F99L/C122S/G151N/Q175R/Q192G/D217Q | 401 |
| 500 | I41S/F97E/F99L/C122S/G151N/Q175G/Q192R/D217A | 74.3 |
| 501 | I41G/F97S/F99L/C122S/G151T/Q175R/Q192A/D217Y | 52.8 |
| 502 | I41G/F97L/F99L/C122S/G151N/Q175A/Q192V/D217R | 34 |
| 503 | I41G/F97T/F99M/C122S/G151D/Q175T/Q192T/D217V | 45.6 |
| 504 | I41G/F97L/F99L/C122S/G151T/Q175M/Q192D/D217M | 36.8 |
| 505 | F97S/F99L/C122S/G151N/Q175I/Q192T/D217T | 524 |
| 506 | I41G/F99L/C122S/G151N/Q175I/Q192T/D217T | 108 |
| 507 | I41G/F97S/C122S/G151N/Q175I/Q192T/D217T | 860 |
| 508 | I41G/F97S/F99L/C122S/Q175I/Q192T/D217T | 155 |
| 509 | I41G/F97S/F99L/C122S/G151N/Q192T/D217T | 105 |
| 510 | I41G/F97S/F99L/C122S/G151N/Q175I/D217T | 107 |
| 511 | I41G/F97S/F99L/C122S/G151N/Q175I/Q192T | 97.7 |
| 512 | F97R/ins97aT/T98V/C122S/Q175M/Q192D/D217S | 42.2 |
| 513 | F97V/ins97aH/T98R/F99L/C122S/Q175R/Q192G/D217S | 905 |
| 514 | F97Q/F99L/C122S/Q175N/Q192V/D217G | 3670 |
| 515 | F97L/ins97aM/T98N/F99L/C122S/Q175T/Q192T/D217S | 256 |
| 516 | F97S/ins97aN/T98G/F99M/C122S/Q175T/Q192T/D217S | 2400 |
| 517 | I41T/F97H/F99L/C122S/G151N/Q175H/Q192V/D217L | 131 |
| 518 | I41R/F97T/F99L/C122S/G151N/Q175T/Q192T/D217I | 159 |
| 519 | I41E/F97V/F99L/C122S/G151N/Q175L/Q192S/D217H | 49.4 |
| 520 | I41D/F97R/F99L/C122S/G151Q/Q175R/Q192V/D217L | 88 |
| 521 | I41E/F97R/F99L/C122S/G151Q/Q175G/Q192T/D217V | 13 |
| 522 | I41D/F97T/F99L/C122S/G151N/Q175S/Q192T/D217A | 70.9 |
| 523 | I41E/F97A/F99M/C122S/G151N/Q175R/Q192S/D217E | 485 |
| 524 | I41G/F99L/C122S/Q175I/Q192T/D217T | 81.8 |
| 525 | I41G/F99L/C122S/G151N/Q192T/D217T | 44.7 |
| 526 | I41G/F99L/C122S/G151N/Q175I/Q192T | 51.6 |
| 527 | F97V/F99L/C122S/G151N/Q175L/Q192S/D217H | 91.6 |
| 528 | I41E/F99L/C122S/G151N/Q175L/Q192S/D217H | 27.1 |
| 529 | I41E/F97V/F99L/C122S/Q175L/Q192S/D217H | 44.3 |
| 530 | I41E/F97V/F99L/C122S/G151N/Q192S/D217H | 42.2 |
| 531 | I41E/F97V/F99L/C122S/G151N/Q175L/D217H | 16.5 |
| 532 | I41E/F97V/F99L/C122S/G151N/Q175L/Q192S | 51.2 |
| 533 | F97R/F99L/C122S/G151Q/Q175R/Q192V/D217L | 137 |
| 534 | I41D/F99L/C122S/G151Q/Q175R/Q192V/D217L | 31.6 |
| 535 | I41D/F97R/F99L/C122S/Q175R/Q192V/D217L | 50.6 |
| 536 | I41D/F97R/F99L/C122S/G151Q/Q192V/D217L | 42.3 |
| 537 | I41D/F97R/F99L/C122S/G151Q/Q175R/D217L | 19.4 |

TABLE 15-continued

| hC3 Cleavage with Modified MTSP-1 Polypeptides | | |
|---|---|---|
| SEQ ID NO.* | Chymotrypsin Numbering MODIFICATIONS | $EC_{50}$ (nM) |
| 538 | I41D/F97R/F99L/C122S/G151Q/Q175R/Q192V | 79.4 |
| 539 | I41E/F97R/F99L/C122S/G151Q/Q175G/Q192T | 41.1 |
| 540 | I41D/F99L/C122S/G151N/Q175S/Q192T/D217A | 30.5 |
| 541 | I41D/F97T/F99L/C122S/Q175S/Q192T/D217A | 52.1 |
| 542 | I41D/F97T/F99L/C122S/G151N/Q192T/D217A | 70.4 |
| 543 | I41D/F97T/F99L/C122S/G151N/Q175S/D217A | 25.5 |
| 544 | I41D/F97T/F99L/C122S/G151N/Q175S/Q192T | 56.7 |
| 545 | F97T/F99L/C122S/G151N/Q175S/Q192T/D217A | 172 |
| 546 | I41S/F97Q/F99L/C122S/Q175W/Q192V/D217R | 50.6 |
| 547 | I41G/F97L/F99L/C122S/G151N/Q192V/D217L | 112 |
| 548 | I41G/F97A/F99L/C122S/G151N/Q175M/Q192S | 73.1 |
| 549 | I41G/F97V/F99L/C122S/G151N/Q192T/D217V | 30.5 |
| 550 | I41D/F97R/F99L/C122S/Q175L/Q192T/D2171 | 5.72 |
| 551 | I41E/F97S/F99L/C122S/Q175L/Q192V/D217A | 89.9 |
| 552 | F97L/F99L/C122S/Q175K/Q192V/D217M | 463 |
| 553 | F97E/F99L/C122S/G151A/Q192V | 1040 |
| 554 | F97E/F99L/C122S/Q175H/Q192V/D217P | 7770 |
| 555 | F97R/ins97a1/T98P/C122S/Q175M/Q192V/D2171 | 23.6 |
| 556 | I41D/F99L/C122S/G151N/Q192T/D217A | 45.1 |
| 557 | I41D/F99L/C122S/G151N/Q175S/Q192T | 28.6 |
| 558 | I41D/F97T/F99L/C122S/G151N/Q192T | 84.3 |
| 559 | I41D/F99L/C122S/G151N/Q192T | 47 |
| 560 | I41D/F99L/C122S/Q175S/Q192T | 27.4 |
| 561 | I41D/F99L/C122S/Q192T | 59.4 |
| 562 | Q38R/I41G/Y6OgG/F99M/C122S/G151N/Q192R | 147 |
| 563 | Q38K/I41G/Y60gG/F99L/C122S/G151N/Q192H | 17.9 |
| 564 | Q38L/I41R/Y60gF/F99L/C122S/G151N/Q192A | 151 |
| 565 | Q38K/I41D/Y60gG/F99L/C122S/G151N | 52.7 |
| 566 | Q38R/I41R/Y60gF/F99L/C122S/G151N/Q192G | 197 |
| 567 | Q38S/I41S/Y60gW/F99L/C122S/G151D/Q192T | 15 |
| 568 | Q38K/I41G/Y60gW/F99L/C122S/G151N/Q192A | 9.96 |
| 569 | Q38H/I41S/Y60gW/C122S/G151H/Q192A | 8.96 |
| 570 | Q38K/I41S/Y60gW/F99L/C122S/G151N/Q192G | 35.1 |
| 571 | Q38F/I41S/Y60gA/C122S/G151N/Q192R | 33.1 |
| 572 | Q38R/I41S/Y60gW/F99L/C122S/G151N/Q192E | 116 |
| 573 | Q38K/I41R/Y6OgG/F99L/C122S/G151N/Q192G | 335 |
| 574 | Q38R/I41R/F99L/C122S/G151N/Q192G | 248 |
| 575 | Q38R/I41R/Y60gL/F99L/C122S/G151N/Q192G | 388 |
| 576 | I41E/C122S/G151N/Q175L/Q192A | 45 |
| 577 | I41S/F99M/C122S/G151N/Q175L/Q192G | 62 |
| 578 | I41E/F99L/C122S/G151N/Q175L/Q192A | 28.5 |
| 579 | I41S/F99L/C122S/G151H/Q175L/Q192V | 20.9 |
| 580 | I41G/F99L/C122S/G151N/Q192A | 61 |
| 581 | I41S/F99M/C122S/G151N/Q175G/Q192R | 95.3 |
| 582 | I41E/F99L/C122S/G151N/Q175R/Q192H | 102 |
| 583 | I41S/F99M/C122S/G151N/Q175E/Q192R | 297 |
| 584 | I41E/F99L/C122S/G151N/Q192V | 156 |
| 585 | I41E/F99L/C122S/G151N/Q192S | 112 |
| 586 | I41S/F99L/C122S/G151N/Q175P/Q192V | 35.8 |
| 587 | I41E/F99L/C122S/G151N/Q175G/Q192T | 30.2 |
| 588 | I41S/C122S/G151N/Q175R/Q192R | 134 |
| 589 | I41S/F99M/C122S/G151N/Q175P/Q192S | 139 |
| 590 | I41S/C122S/G151N/Q175D/Q192R | 96.8 |
| 591 | I41E/F99L/C122S/G151N/Q175R/Q192T | 155 |
| 592 | I41G/F99L/C122S/G151N/Q175R/Q192A | 74.5 |
| 593 | F99L/C122S/G151N/Q192T | 225 |
| 594 | I41D/F99L/C122S/G151N | 16.9 |
| 595 | I41S/F99L/C122S/Q175P/Q192V | 64.3 |
| 596 | I41S/F99L/C122S/G151N/Q175P | 13.9 |
| 597 | I41E/F99L/C122S/Q175G/Q192T | 33.9 |
| 598 | I41E/F99L/C122S/G151N/Q175G | 20 |
| 599 | I41D/Y59F/F99L/C122S/G151N/Q192T/V213A | 414 |
| 600 | I41D/G43A/F99L/C122S/G151N/Q192T/P232S/K239R | 37.6 |
| 601 | I41D/G43A/D96E/F99L/C122S/G151N/Q192T | 45 |
| 602 | I41D/D96E/F99L/C122S/G151N/Q192T | 51.5 |
| 603 | I41D/D96E/C122S/G151N/Q192T | 78.8 |
| 604 | I41D/D96E/F99L/C122S/G151N/Q192T/D217E | 27.6 |
| 605 | I41D/F99L/M117T/C122S/G151N/Q192T/A204D/D217E | 25.3 |
| 606 | I41D/F99L/C122S/G151N/Q192T/D217E | 22 |
| 607 | I41D/F99L/C122S/I136M/G151N/Q192T/D217L/K224R | 32.2 |
| 608 | I41D/F60eI/D96E/F99L/C122S/G151N/Q192T | 47.9 |
| 609 | I41D/C122S/G151N/Q192T/D217E | 34.2 |
| 610 | D96E/C122S/G151N/Q192T | 298 |
| 611 | Y59F/C122S/G151N/Q192T | 288 |

TABLE 15-continued

| hC3 Cleavage with Modified MTSP-1 Polypeptides | | |
|---|---|---|
| SEQ ID NO.* | Chymotrypsin Numbering MODIFICATIONS | $EC_{50}$ (nM) |
| 612 | Q38H/I41S/D60bT/F60eS/Y60gW/D96K/F97G/F99L/C122S/G151H/Q175L/Q192D | 7.34 |
| 613 | I41S/ins97aV/C122S/Q192D | 336 |
| 614 | I41S/F97L/F99L/C122S/Q192S | 19.1 |
| 615 | I41T/F97R/ins97aV/T98L/C122S/Q192S | 13.2 |
| 616 | I41S/F97V/T98N/F99L/C122S/Q192S | 29.4 |
| 617 | I41S/F97G/ins97aA/T98L/C122S/Q192A | 6.75 |
| 618 | I41S/F97D/F99L/C122S/Q192V | 31 |
| 619 | I41E/F97L/F99L/C122S/Q192A | 47.4 |
| 620 | I41S/F97A/ins97aV/T98L/C122S/Q192A | 5.3 |
| 621 | I41S/F97del/T98S/F99L/C122S/Q192S | 23.2 |
| 622 | I41A/Y60gW/D96F/F97G/F99M/C122S/Q175W/Q192A | 4.06 |
| 623 | I41G/Y60gW/F99L/C122S/Q175R/Q192S | 6.95 |
| 624 | I41A/Y60gW/ins97aE/F99L/C122S/Q175M/Q192T | 8.9 |
| 625 | I41T/ins97aA/F99Y/C122S/Q175L/Q192A | 28 |
| 626 | I41A/ins97aY/F99L/C122S/Q175R/Q192H | 14.8 |
| 627 | I41S/ins97aT/F99L/C122S/Q175R/Q192H | 27.5 |
| 628 | I41S/Y60gW/ins97aN/F99L/C122S/Q175R/Q192T | 12 |
| 629 | Q38H/I41S/D96S/ins97aK/C122S/G151N/Q192A | 16.7 |
| 630 | Q38H/I41A/D96A/ins97aA/C122S/G151D/Q192T | 9.25 |
| 631 | Q38H/I41S/D96Q/ins97aT/C122S/G151N/Q192A | 17.9 |
| 632 | Q38H/I41T/D96M/ins97aA/C122S/G151D | 10.8 |
| 633 | Q38Y/I41A/D961/ins97aQ/C122S | 4.26 |
| 634 | Q38H/I41S/D96K/ins97aT/C122S/G151K/Q192A | 19.2 |
| 635 | Q38W/I41S/D96R/ins97aA/C122S/G151N/Q192A | 9.5 |
| 636 | Q38H/I41A/D96R/ins97aQ/C122S | 7.6 |
| 637 | Q38F/I41V/D96Q/ins97aT/C122S/G151D | 9.89 |
| 638 | L33M/Q38F/I41S/D96A/ins97aW/C122S/G151N/Q192S | 10.6 |
| 639 | Q38H/I41S/D96V/ins97aA/C122S/G151N/Q192A | 16 |
| 640 | Q38H/I41T/D96K/ins97aL/C122S/G151N/Q192A | 44.7 |
| 641 | Q38H/I41S/D96Q/ins97aA/C122S/Q192T | 10.2 |
| 642 | Q38W/I41V/D96R/ins97aA/C122S/G151N | 4.49 |
| 643 | Q38Y/I41T/D96M/ins97aS/C122S/G151N | 12.5 |
| 644 | Q38H/I41S/D96K/ins97aS/C122S/G151P/Q192S | 25.6 |
| 645 | Q38H/I41S/D96G/ins97aG/C122S/G151N/Q192A | 34.6 |
| 646 | Q38H/I41S/D96K/ins97aD/C122S/G151N/Q192S | 26.8 |
| 647 | I41S/D96E/ins97aG/C122S/G151Q/Q192A | 44.4 |
| 648 | I41S/Y59F/ins97aV/C122S/G187D/Q192V/D217V | 8.35 |
| 649 | A35V/I41S/Y59F/C122S/Q192D/D217V | 39.8 |
| 650 | I41S/F93L/ins97aV/C122S/Q192V/D217V | 9.82 |
| 651 | I41S/S90P/ins97aV/C122S/Y146E/Q192N/D217V | 6.47 |
| 652 | I41S/S90T/ins97aV/C122S/Q192N/D217V | 13.4 |
| 653 | I41S/S90T/ins97aV/C122S/Q192V/D217V | 10.5 |
| 654 | I41S/Y59F/ins97aV/C122S/Q192G | 25.6 |
| 655 | I41S/Y59F/F97S/ins97aV/S116Y/C122S/Q192G/D217V | 8.22 |
| 656 | I41S/ins97aV/C122S/Q192G/Q209L | 33.4 |
| 657 | Q38H/I41S/ins97aV/A112V/C122S/Q192A/Q209L | 10.9 |
| 658 | I41S/ins97aV/C122S/Q192V/D217V | 11 |
| 659 | I41S/Y59F/ins97aV/C122S/Q192A | 16.6 |
| 660 | I41A/F97G/ins97aM/T98L/C122S | 40.1 |
| 661 | I41G/F97E/F99L/C122S/Q192A | 30.1 |
| 662 | I41S/F97V/ins97aV/T98P/C122S | 30.9 |
| 663 | I41S/T98S/F99L/C122S/Q192A | 17.4 |
| 664 | I41S/F97Q/F99L/C122S/Q192S | 53.5 |
| 665 | I41G/F97L/F99L/C122S/Q192S | 41.4 |
| 666 | I41S/F97G/ins97aA/T98P/C122S/Q192A | 57.2 |
| 667 | I41A/F97G/ins97aV/T98E/C122S | 18.1 |
| 668 | I41A/F97S/ins97aA/C122S | 19.8 |
| 669 | I41A/F97W/T98S/F99L/C122S/Q192A | 27 |
| 670 | I41L/N95D/D96T/F97W/F99L/C122S/Q192A | 62.6 |
| 671 | I41T/Y60gL/N95D/D96F/F97S/F99L/C122S/Q175S/Q192A | 247 |
| 672 | I41A/Y60gW/N95D/D96F/F97G/F99L/C122S/Q175H/Q192A | 17.5 |
| 673 | I41A/Y60gW/F99L/C122S/Q175T/Q192A | 17.6 |
| 674 | Q38M/I41T/D96M/ins97aH/C122S/G151E | 19.1 |
| 675 | Q38H/I41T/D96R/ins97aG/C122S/G151S | 54.1 |
| 676 | I41S/D60bY/ins97aV/T98N/C122S/Q192H | 8.1 |
| 677 | I41S/Y59F/D60bY/ins97aV/C122S/Q192G | 5.24 |
| 678 | I41S/D60bY/ins97aV/A112V/C122S/Q192G/Q209L | 4.76 |
| 679 | A35T/I41S/Y59F/ins97aV/C122S/Y146FN183A/Q192G/R235H | 18.4 |
| 680 | I41S/D96K/F97G/ins97aV/T98P/F99L/C122S/Q175H/Q192D | 195 |
| 681 | I41S/ins97aV/C122S/N164D/Q192G/R235H | 46.4 |
| 682 | I41S/Y59F/ins97aV/C122S/Q192G/N223D | 34.1 |
| 683 | I41S/ins97aV/C122S/N164D/Q192G/R235L | 49.7 |
| 684 | I41S/Y59F/F97Y/ins97aV/C122S/Q192G | 29.1 |
| 685 | I41S/D96K/F97G/ins97aV/T98P/F99L/C122S/Q192V | 32.3 |

TABLE 15-continued

| hC3 Cleavage with Modified MTSP-1 Polypeptides | | |
|---|---|---|
| SEQ ID NO.* | Chymotrypsin Numbering MODIFICATIONS | $EC_{50}$ (nM) |
| 686 | I41S/F99L/C122S/G151N/Q175M/Q192G/D217V | 3.19 |
| 687 | I41S/F97L/F99L/C122S/G151N/Q192G/D217V | 11.9 |
| 688 | I41S/F97S/F99L/C122S/G151N/Q175L/Q192A/D217L | 11.2 |
| 689 | I41G/F97R/F99L/C122S/G151N/Q175L/Q192S/D217V | 4.18 |
| 690 | I41T/F97L/F99L/C122S/G151N/Q175S/Q192S/D217W | 24.2 |
| 691 | I41D/F97T/F99M/C122S/Q192V/D217M | 63.8 |

*SEQ ID of the protease domain containing the replacements; it is understood that these replacements can be included in full-length MTSP-1 and in other variants, including catalytically active fragments thereof.

Among these of interest are those with an $EC_{50}$ for hC3 cleavage of less than 10, such as, but are not limited to, for example:

| $EC_{50}$ (nM) | Mutation string | SEQ ID NO. |
|---|---|---|
| 0.866 | ins97aA/F97G/T98L/C122S/Q175M/Q192A/D217I/K224R | 368 |
| 0.867 | Q38G/H40R/I41H/D60bN/F97D/F99L/C122S/Q175L/Q192G | 286 |
| 1.08 | Q38Y/I41S/D60bT/F60eR/Y60gW/D96M/F97N/T98G/F99L/C122S/G151N/Q175L | 491 |
| 1.11 | Q38H/I41A/D60bV/F60eR/Y60gW/D96P/ins97aN/F97W/T98G/F99L/C122S/G151H/Q175L/Q192E | 432 |
| 1.17 | Q38H/I41S/D60bT/F60eS/Y60gW/D96F/F97D/ins97aE/T98S/F99L/C122S/G151H/Q175L/Q192A | 425 |
| 1.25 | Q38F/I41A/D60bT/F60eG/Y60gW/ins97aE/F97T/T98G/F99L/C122S/Q175L/Q192E | 353 |
| 1.31 | Q38H/I41S/D60bT/F60eS/Y60gW/ins97aV/F97D/T98P/F99L/C122S/G151H/Q175L | 447 |
| 1.39 | Q38H/I41A/D60bV/F60eT/Y60gW/ins97aE/F97T/T98G/F99L/C122S/Q175L/Q192E | 311 |
| 1.43 | Q38H/I41S/D60bT/F60eS/Y60gW/D96K/F97G/ins97aA/T98P/F99L/C122S/G151H/Q175L/Q192D | 496 |
| 1.45 | Q38H/I41S/D60bT/F60eS/Y60gW/D96K/F97G/ins97aV/T98P/F99L/C122S/G151H/Q175L | 40 |
| 1.51 | Q38H/I41A/D60bV/F60eR/Y60gW/D96P/ins97aN/F97W/T98G/F99L/C122S/G151N/Q175L/Q192E | 413 |
| 1.53 | Q38Y/I41A/D60bL/F60eQ/ins97aV/F97D/T98P/F99L/C122S/G151N/Q175M/Q192A | 330 |
| 1.57 | Q38H/I41S/D60bF/F60eV/F97D/ins97aV/T98P/F99L/C122S/G151N/Q175L/Q192A | 337 |
| 1.57 | Q38H/I41A/D60bV/F60eA/Y60gW/F97T/ins97aE/T98G/F99L/C122S/Q175L/Q192V | 356 |
| 1.57 | Q38H/I41A/D60bV/F60eR/Y60gW/D96I/ins97aN/F97Y/T98G/F99L/C122S/G151H/Q175L/Q192D | 428 |
| 1.59 | Q38H/I41S/D60bT/F60eS/Y60gW/D96L/ins97aG/F97D/T98N/F99L/C122S/G151H/Q175L/Q192E | 426 |
| 1.83 | Q38H/I41A/D60bV/F60eR/Y60gW/D96P/ins97aN/F97W/T98G/F99L/C122S/G151H/Q175L/Q192D | 434 |
| 1.96 | Q38F/I41S/D60bF/F60eR/Y60gF/F97T/ins97aE/T98G/F99L/C122S/G151N/Q175L/Q192V | 324 |
| 1.97 | Q38H/I41S/D60bY/D96Y/ins97aV/F97D/T98P/F99L/L106M/C122S/I136M/Q192G/Q209L/D217T | 407 |
| 2.07 | Q38H/I41A/D60bV/F60eR/Y60gW/D96S/ins97aR/F97A/T98S/F99L/C122S/G151N/Q175L/Q192T | 412 |
| 2.23 | Q38H/I41A/D60bV/F60eR/Y60gW/D96I/ins97aN/F97Y/T98G/F99L/C122S/G151N/Q175L/Q192D | 408 |
| 2.28 | Q38H/I41A/D60bT/F60eH/Y60gW/ins97aE/F97T/T98G/F99L/C122S/Q175L/Q192D | 315 |
| 2.37 | Q38H/I41A/D60bV/F60eR/Y60gW/ins97aE/F97T/T98G/F99L/C122S/Q175L/Q192D | 294 |
| 2.42 | ins97aY/F97G/T98V/C122S/Q175M/Q192S/D217V | 372 |
| 2.43 | Q38H/I41S/D60bS/ins97aV/F97D/T98P/F99L/M117L/C122S/I136T/Q192G/D217I | 386 |
| 2.52 | Q38H/I41A/D60bV/F60eR/Y60gW/D96I/F97N/T98G/F99L/C122S/G151H/Q175L/Q192D | 429 |
| 2.54 | Q38H/I41A/D60bV/F60eR/Y60gW/D96P/ins97aN/F97W/T98G/F99L/C122S/G151N/Q175L/Q192D | 433 |
| 2.71 | Q38H/I41A/D60bT/F60eK/Y60gW/F97T/ins97aE/T98G/F99L/C122S/Q175L/Q192A | 355 |

-continued

| $EC_{50}$ (nM) | Mutation string | SEQ ID NO. |
|---|---|---|
| 2.76 | H40R/I41H/F97D/F99L/C122S/Q175M/Q192G/D217V/K224Y | 172 |
| 2.84 | I41G/F97I/F99L/C122S/G151L/Q175M/Q192S/D217V | 80 |
| 2.85 | Q38H/I41S/D60bT/F60eS/Y60gW/D96V/F97G/ins97aV/T98P/F99L/C122S/G151H/Q175L/Q192D | 36 |
| 2.87 | Q38H/I41A/D60bV/F60eR/Y60gW/D96I/F97N/T98G/F99L/C122S/G151N/Q175L/Q192D | 32 |
| 2.88 | Q38H/I41S/D60bT/F60eS/Y60gW/D96K/F97G/ins97aV/T98P/F99L/C122S/T150S/G151H/Q175L/Q192D/Q209L | 495 |
| 2.91 | Q38H/I41A/D60bV/F60eI/Y60gW/F97T/ins97aE/T98G/F99L/C122S/G151N/Q175L/Q192D | 340 |
| 3.04 | Q38H/I41S/D60bT/F60eS/Y60gW/D96I/F97N/T98G/F99L/C122S/G151N/Q175L/Q192D | 436 |
| 3.06 | Q38H/I41A/D60bW/ins97aV/F97D/T98P/F99L/C122S/I136M/Q192G/D217N | 388 |
| 3.07 | Q38H/I41S/D60bF/F60eT/ins97aV/F97D/T98P/F99L/C122S/H143Q/G151N/Q175L/Q192G | 419 |
| 3.08 | Q38Y/I41S/D60bT/Y60gW/D96M/F97N/T98G/F99L/C122S/G151N/Q175L/Q192D | 484 |
| 3.09 | Q38H/I41A/F60eH/Y60gW/ins97aE/F97T/T98G/F99L/C122S/Q175L/Q192A | 354 |
| 3.1 | I41T/D60bW/F60eH/F97D/ins97aV/T98P/F99L/C122S/G151N/Q175L/Q192G | 335 |
| 3.13 | Q38H/I41S/D60bT/F60eS/Y60gW/D96F/F97Y/ins97aD/T98G/F99L/C122S/G151H/Q175L/Q192D | 472 |
| 3.14 | Q38H/I41A/D60bV/F60eR/Y60gW/D96F/F97S/ins97aH/T98G/F99L/C122S/G151N/Q175L/Q192G | 469 |
| 3.19 | Q38H/I41S/D60bT/F60eS/Y60gW/ins97aV/T98P/F99L/C122S/G151H/Q175L/Q192E | 441 |
| 3.19 | I41S/F99L/C122S/G151N/Q175M/Q192G/D217V | 686 |
| 3.22 | Q38R/I41S/D60bY/F60eD/ins97aV/F97D/T98P/F99L/C122S/G151N/Q175M/Q192A | 332 |
| 3.27 | Q38Y/I41S/D60bT/F60eR/Y60gW/D96M/T98G/F99L/C122S/G151N/Q175L/Q192D | 487 |
| 3.72 | H40R/I41H/Y60gH/F97D/F99L/C122S/Q175M/Q192G/D217I/K224L | 177 |
| 3.72 | Q38H/I41A/D60bV/F60eR/Y60gW/F97D/F99L/C122S/G151H/Q175L/Q192D | 435 |
| 3.75 | Q38Y/I41S/D60bT/F60eR/Y60gW/D96M/F97N/T98G/F99L/C122S/Q175L/Q192D | 492 |
| 3.76 | Q38H/I41A/D60bV/F60eR/Y60gW/D96F/F97Y/ins97aN/T98G/F99M/C122S/G151N/Q175L/Q192G | 470 |
| 4.53 | Q38H/I41S/D60bT/F60eS/Y60gW/D96Y/F97N/ins97aE/T98S/F99L/C122S/G151H/Q175L/Q192D | 473 |
| 5.92 | Q38H/I41S/D60bT/F60eS/Y60gW/D96K/F97D/ins97aA/T98P/F99L/C122S/G151N/Q175L/Q192D | 37 |
| 6.86 | Q38H/I41S/D60bT/F60eS/Y60gW/D96K/ins97aV/F97G/T98P/F99L/C122S/G151H/Q175L/Q192D | 35 |

Example 3

Confirmation of Cleavage at the Targeted Q H A R↓A S H L Site in C3

Two independent analytical methods were used to characterize the cleavage site(s) of C3 by the MTSP-1 protease domain variant that contains the modifications Q38H/I41S/D60bT/F60eS/Y60gW/D96K/F97G/ins97aV/T98P/F99L/C122S/G151H/Q175L/Q192D: (a) direct analysis of cleavage products by MALDI-MS with identification of released peptides in the 1-40 kDa range and (b) LC-tandem MS of a labeled proteolytic digest with sequence analysis of product peptides that contain a neo-N-terminus. These experiments were performed as follows:

(a) C3 (1 mg/ml in PBS buffer) was incubated with u-PA protease variant at enzyme to substrate ratios of 1:50 for a total of one hour. Samples (50 µl) were removed from these reactions at 0, 5, 10, 20, 40, and 60 minutes, and the cleavage reaction was terminated in each sample by addition of 1 µl 1% TFA and flash freezing in dry ice. Samples were then reduced with 25 mM TCEP (1 hr at 37° C.), then desalted via C18 solid phase extraction (Agilent Omix). The resulting cleavage products were analyzed directly by MALDI-MS (ABI 4700). At each time point after 0 minutes a fragment of MW 8289±1 Da was observed, indicating cleavage at the arginine in the QHAR|ASHG site in C3. No additional C3 cleavage sites were observed in these reactions.

(b) The C3/protease variant mixture (10 µl) was denatured in 6M guanidine, then cysteine side chains were reduced (30 mM TCEP) and alkylated (iodoacetamide). The s-amino group of lysine side chains was blocked by treatment with O-methylisourea (3 µl OMU, 8 µl 1M NaOH, 15 min at 65° C.; quench with 2 µl 1:1 TFA-water, followed by SPE cleanup) and then peptide amino termini were labeled with SulfoNHS-SS-biotin (50 mM HEPES, 250 uM biotin reagent, 30 min at RT). After proteolytic digestion with either trypsin or Glu-C, the biotin-labeled peptides were captured by avidin beads. Cleavage of the biotin label was achieved with reduction (TCEP), giving a neo-N-terminal peptide fraction with a N-thioacyl label. This peptide fraction was analyzed by LC-tandem MS (Thermo LTQ-XL); the major C3-related component identified was the peptide (N-thioacyl)-ASHGLAR, indicating cleavage at the QHAR|ASHG site in C3.

Q H A R↓A S H L 737-744
P4 P3 P1 ↓P1' P4'.

Example 4

Ex Vivo Pharmacodynamic (PD) Analysis of MTSP-1 Variants in Cynomolgus Monkey Plasma The cleavage of C3 in anti-coagulated EDTA-treated cynomolgus monkey plasma by the wild type and modified MTSP-1 polypeptides was measured as described below. A C3 ELISA was used to measure the effective dose ($ED_{50}$) of wild type and modified MTSP-1 polypeptides required to cleave 50% of the C3 in the "test," anti-coagulated plasma. The cleavage reactions contained 80% plasma, and each protease was assayed at 9 different concentrations in addition to a zero protease control. The highest concentration of wild type MTSP-1 used in this reaction was 6 µM and the next eight concentrations were prepared by sequential dilutions by a factor of 1.5. The highest concentration used for MTSP-1 variant proteins was 150 nM and, as with the wild type protein, the next eight concentrations were prepared by sequential dilutions by a factor of 1.5. Following addition of test protease, the reaction was incubated for 10 minutes at 37° C. The reaction was then rapidly quenched by addition of the protease inhibitor 10 µM EGR-CMK (Glu-Gly-Arg-chloromethyl ketone) and the quenched samples were placed at room temperature for 30 minutes before performing the C3 ELISA. Cleavage reactions were diluted 1:2700 in BSA-PBST and uncleaved C3 was "captured" with Goat anti huC3 (A213 CompTech) (adsorbed to a microtiter plate) and "detected" by 0.5 µg/ml MAB anti-huC3a (Abeam ab11872) in 1% BSA-PBST. The ELISA was then "developed" using Goat anti Mouse HRP conjugate and the WesternBright Sirius Western Blotting Detection Kit following the manufacturer's directions.

TABLE 16 hC3 cleavage with modified MTSP-1 polypeptides in Cynomolgus monkey plasma

| Chymotrypsin numbering | SEQ ID NO.* | $ED_{50}$ 80% cynomolgus plasma (nM) |
|---|---|---|
| Wild-type MTSP-1 protease domain with C122S | 4 | 2800 |
| I41R/F97T/Ins97aE/T98G/F99L/C122S/G151N/Q175L/Q192E | 21 | 2200 |
| Q38H/I41A/D60bV/F60eR/Y60gW/F97T/ins97aE/T98G/F99L/C122S/G151N/Q175L/Q192D | 22 | 101 |
| Q38H/I41A/D60bT/F60eK/Y60gW/F97T/ins97aE/T98G/F99L/C122S/G151N/Q175L/Q192D | 23 | 195 |
| Q38H/I41S/D60bT/F60eS/Y60gW/F97D/ins97aV/T98P/F99L/C122S/G151H/Q175L/Q192E | 24 | 76 |
| Q38H/I41S/D60bT/F60eS/Y60gW/F97D/ins97aV/T98P/F99L/C122S/G151H/Q175L/Q192D | 25 | 152 |
| Q38H/I41A/D60bT/F60eK/Y60gW/F97T/ins97aE/T98G/F99L/C122S/G151H/Q175L/Q192D | 26 | 136 |
| Q38H/I41S/D60bT/F60eS/Y60gW/F97D/ins97aV/T98P/F99L/C122S/G151N/Q175L/Q192D | 27 | 118 |
| Q38H/I41A/D60bV/F60eR/Y60gW/F97T/ins97aE/T98G/F99L/C122S/G151H/Q175L/Q192D | 28 | 133 |
| Q38H/I41A/D60bV/F60eR/Y60gW/D961/F97Y/ins97aN/T98G/F99L/C122S/G151N/Q175L/Q192D | 29 | 37 |
| Q38H/I41S/D60bT/F60eS/Y60gW/D96K/F97D/ins97aA/T98P/F99L/C122S/G151H/Q175L/Q192D | 30 | 85 |
| Q38H/I41A/D60bV/F60eR/Y60gW/D96P/F97W/ins97aN/T98G/F99L/C122S/G151N/Q175L/Q192E | 31 | 73 |
| Q38H/I41A/D60bV/F60eR/Y60gW/D961/F97N/T98G/F99L/C122S/G151N/Q175L/Q192D | 32 | 58 |
| Q38H/I41S/D60bT/F60eS/Y60gW/D96Y/F97E/ins97aV/T98G/F99L/C122S/G151H/Q175L/Q192D | 33 | 133 |
| Q38H/I41S/D60bT/F60eS/Y60gW/D96L/F97D/ins97aG/T98N/F99L/C122S/G151H/Q175L/Q192E | 34 | 70 |
| Q38H/I41S/D60bT/F60eS/Y60gW/D96K/F97G/ins97aV/T98P/F99L/C122S/G151H/Q175L/Q192D | 35 | 92 |
| Q38H/I41S/D60bT/F60eS/Y60gW/D96V/F97G/ins97aV/T98P/F99L/C122S/G151H/Q175L/Q192D | 36 | 103 |
| Q38H/I41S/D60bT/F60eS/Y60gW/D96K/F97D/ins97aA/T98P/F99L/C122S/G151N/Q175L/Q192D | 37 | 37 |

*SEQ ID of the protease domain containing the replacements

Example 5

Ex Vivo Stability of Modified MTSP-1 Polypeptides in Cynomolgus Monkey Vitreous Humor The ex vivo stability of modified MTSP-1 polypeptides was assessed in purchased cynomolgus monkey vitreous humor or Phosphate Buffered Saline (PBS) negative control. Modified MTSP-1 polypeptides that exhibit stability in vitreous humor can be used for treatment of AMD.

80% Cynomolgus vitreous humor (obtained from Bio-Chemed; Catalog Nos. BC7615-V1, BC60815-V1, BC33115-V6) in buffer containing 50 mM Tris pH 8.0, 50 mM NaCl, and 0.01% Tween-20 or PBS control was incubated with modified MTSP-1 polypeptides at a final concentration of 0.1 µM. The mixture was incubated at 37° C. for 7 days. The residual protease activity was assayed with 100 µM fluorogenic substrate AGR-ACC (7-amino-4-carbamoylmethyl-coumarin) in 50 mM Tris, pH 8.0, 50 mM NaCl, 0.01% Tween-20 and the results were assessed at excitation wavelength=380 nm and emission wavelength=460 nm. The results show that the modified MTSP-1 polypeptides with the sequences set forth in SEQ ID NOS: 35, 38-40, and 47-56 exhibit comparable residual activity (i.e., stability) after incubation in cynomolgus plasma and PBS. The results are set forth in Table 17 below.

TABLE 17

Stability of MTSP-1 polypeptides in vitreous humor

| Chymotrypsin numbering | SEQ ID NO.* | Activity (%) on Day 7 | |
|---|---|---|---|
| | | vitreous | PBS |
| Wild-type MTSP-1 protease domain with C122S | 4 | 59 | 63 |
| Q38H/I41S/D60bT/F60eS/Y60gW/D96K/F97G/ins97aV/T98P/F99L/C122S/G151H/Q175L/Q192D | 35 | 92 | 94 |
| Q38H/I41S/D60bT/F60eS/Y60gW/F97G/ins97aV/T98P/F99L/C122S/G151H/Q175L/Q192D | 38 | 73 | 91 |
| Q38H/I41S/D60bT/F60eS/Y60gW/D96K/ins97aV/T98P/F99L/C122S/G151H/Q175L/Q192D | 39 | 77 | 85 |
| Q38H/I41S/D60bT/F60eS/Y60gW/D96K/F97G/ins97aV/T98P/F99L/C122S/G151H/Q175L | 40 | 18 | 23 |
| I41S/D60bT/F60eS/Y60gW/D96K/F97G/ins97aV/T98P/F99L/C122S/G151H/Q175L/Q192D | 47 | 86 | 87 |
| Q38H/D60bT/F60eS/Y60gW/D96K/F97G/ins97aV/T98P/F99L/C122S/G151H/Q175L/Q192D | 48 | 76 | 78 |
| Q38H/I41S/F60eS/Y60gW/D96K/F97G/ins97aV/T98P/F99L/C122S/G151H/Q175L/Q192D | 49 | 87 | 81 |
| Q38H/I41S/D60bT/Y60gW/D96K/F97G/ins97aV/T98P/F99L/C122S/G151H/Q175L/Q192D | 50 | 85 | 91 |
| Q38H/I41S/D60bT/F60eS/D96K/F97G/ins97aV/T98P/F99L/C122S/G151H/Q175L/Q192D | 51 | 85 | 93 |
| Q38H/I41S/D60bT/F60eS/Y60gW/D96K/F97G/T98P/F99L/C122S/G151H/Q175L/Q192D | 52 | 19 | 34 |
| Q38H/I41S/D60bT/F60eS/Y60gW/D96K/F97G/ins97aV/F99L/C122S/G151H/Q175L/Q192D | 53 | 66 | 82 |
| Q38H/I41S/D60bT/F60eS/Y60gW/D96K/F97G/ins97aV/T98P/C122S/G151H/Q175L/Q192D | 54 | 94 | 98 |
| Q38H/I41S/D60bT/F60eS/Y60gW/D96K/F97G/ins97aV/T98P/F99L/C122S/Q175L/Q192D | 55 | 74 | 87 |
| Q38H/I41S/D60bT/F60eS/Y60gW/D96K/F97G/ins97aV/T98P/F99L/C122S/G151H/Q192D | 56 | 90 | 94 |

*SEQ ID of a protease domain containing the replacements

The ex vivo stability of the modified MTSP-1 polypeptides in purchased Cynomolgus monkey vitreous humor after 7 and 28 days was assessed as above. The results show that the modified MTSP-1 polypeptides provided herein are relatively stable for at least 7 days in vitreous humor. The results are set forth in Table 18 below.

TABLE 18

| Chymotrypsin numbering | SEQ ID NO.* | Activity (%) at 37° C. | |
|---|---|---|---|
| | | Day 7 | Day 28 |
| Wild-type MTSP-1 protease domain with C122S | 4 | 67 | 47 |
| Q38H/I41S/D60bT/F60eS/Y60gW/D96K/F97G/ins97aV/T98P/F99L/C122S/G151H/Q175L/Q192D | 35 | 91 | 68 |
| I41E/F99L/C122S/G151N/Q192T | 41 | 100 | 91 |
| I41D/C122S/G151N/Q192T | 42 | 71 | 35 |
| I41S/F99L/C122S/G151N/Q192V | 43 | 79 | ND |
| I41E/F99L/C122S/G151N/Q192T | 44 | 91 | 90 |
| I41D/Y59F/D96E/F99L/C122S/G151N/Q192T | 45 | 85 | ND |
| I41D/Y59F/C122S/G151N/Q192T | 46 | 88 | 86 |

TABLE 18-continued

| Chymotrypsin numbering | SEQ ID NO.* | Activity (%) at 37° C. Day 7 | Activity (%) at 37° C. Day 28 |
|---|---|---|---|
| Q38H/I41S/D96K/F97G/ins97aV/T98P/F99L/C122S/Q192D | 57 | 95 | 80 |
| I41S/D96K/F97G/ins97aV/T98P/F99L/C122S/Q175L/Q192D | 58 | 96 | 75 |
| Q38H/I41S/D96K/F97G/ins97aV/T98P/F99L/C122S/Q175L/Q192D | 59 | 92 | 63 |

*SEQ ID of the protease domain containing the replacements

Example 6

Ex Vivo Pharmacodynamic Activity in Human Plasma

Serial dilutions of modified MTSP-1 polypeptides (or buffer) were added to human plasma (that contains ~8 μM endogenous C3) to create reaction mixtures that contained 6000, 4000, 2667, 1778, 1185, 790, 527, 351, 234 or 0 nM concentrations of each variant polypeptide and 80% human plasma. Similar reaction mixtures were prepared for wild type MTSP with the wild type MTSP present at concentrations of 150, 100, 67, 44, 30, 20, 13, 9, 6 or 0 nM, These reaction mixtures were incubated for 1 hour at 37° C. and quenched with 10 μM EGR-CMK. Each reaction mixture was diluted 1:15,625 in PBST buffer containing 1% BSA and the residual, uncleaned C3 concentration in the mixture was "detected" using mAb (Abeam ab11872) and the assay signal was "developed" using HRP conjugate Goat anti Mouse-HRP (JIR 115-035-003) and the WesternBright Sirius Western Blotting Detection Kit. These data were used to calculate the concentration of each MTSP polypeptide required to cleave 50% of the C3 present in the plasma during the 1 hour incubation (i.e., the $ED_{50}$).

The results are shown in Table 19 below, which sets forth the $ED_{50}$ (nM) of hemolysis in 80% human plasma by the reference MTSP-1 protease domain comprising the WT-MTSP-1 protease domain with the C122S replacement, and the modified MTSP-1 polypeptides. As shown in Table 19, the $ED_{50}$ for the reference MTSP-1 polypeptide in 80% human plasma is 3500 nM whereas exemplary MTSP-1 polypeptides have increased ability to cleave complement as indicated by a lower $ED_{50}$ (e.g., between 24 nM and 835 nM). For example, the modified MTSP-1 polypeptide with the sequence set forth in SEQ ID NO: 35, which contain the replacements Q38H/I41S/D60bT/F60eS/Y60gW/D96K/F97G/ins97aV/T98P/F99L/C122S/G151H/Q175L/Q192D, was approximately 140-fold more potent than the reference MTSP-1 protease domain with the C122S replacement.

TABLE 19

| Chymotrypsin numbering | SEQ ID NO.* | $ED_{50}$ 80% human plasma (60 min, nM) |
|---|---|---|
| Wild-type MTSP-1 protease domain with C122S | 4 | 3500 |
| I41R/F97T/Ins97aE/T98G/F99L/C122S/G151N/Q175L/Q192E | 21 | 835 |
| Q38H/I41A/D60bV/F60eR/Y60gW/F97T/ins97aE/T98G/F99L/C122S/G151N/Q175L/Q192D | 22 | 52 |
| Q38H/I41A/D60bT/F60eK/Y60gW/F97T/ins97aE/T98G/F99L/C122S/G151N/Q175L/Q192D | 23 | 65 |
| Q38H/I41S/D60bT/F60eS/Y60gW/F97D/ins97aV/T98P/F99L/C122S/G151H/Q175L/Q192E | 24 | 50 |
| Q38H/I41S/D60bT/F60eS/Y60gW/F97D/ins97aV/T98P/F99L/C122S/G151H/Q175L/Q192D | 25 | 50 |
| Q38H/I41A/D60bT/F60eK/Y60gW/F97T/ins97aE/T98G/F99L/C122S/G151H/Q175L/Q192D | 26 | 38 |
| Q38H/I41S/D60bT/F60eS/Y60gW/F97D/ins97aV/T98P/F99L/C122S/G151N/Q175L/Q192D | 27 | 41 |
| Q38H/I41A/D60bV/F60eR/Y60gW/F97T/ins97aE/T98G/F99L/C122S/G151H/Q175L/Q192D | 28 | 32 |
| Q38H/I41A/D60bV/F60eR/Y60gW/D961/F97Y/ins97aN/T98G/F99L/C122S/G151N/Q175L/Q192D | 29 | 27 |
| Q38H/I41S/D60bT/F60eS/Y60gW/D96K/F97D/ins97aA/T98P/F99L/C122S/G151H/Q175L/Q192D | 30 | 34 |
| Q38H/I41A/D60bV/F60eR/Y60gW/D96P/F97W/ins97aN/T98G/F99L/C122S/G151N/Q175L/Q192E | 31 | 47 |
| Q38H/I41A/D60bV/F60eR/Y60gW/D961/F97N/T98G/F99L/C122S/G151N/Q175L/Q192D | 32 | 24 |
| Q38H/I41S/D60bT/F60eS/Y60gW/D96Y/F97E/ins97aV/T98G/F99L/C122S/G151H/Q175L/Q192D | 33 | 38 |
| Q38H/I41S/D60bT/F60eS/Y60gW/D96L/F97D/ins97aG/T98N/F99L/C122S/G151H/Q175L/Q192E | 34 | 39 |
| Q38H/I41S/D60bT/F60eS/Y60gW/D96K/F97G/ins97aV/T98P/F99L/C122S/G151H/Q175L/Q192D | 35 | 25 |
| Q38H/I41S/D60bT/F60eS/Y60gW/D96V/F97G/ins97aV/T98P/F99L/C122S/G151H/Q175L/Q192D | 36 | 27 |
| Q38H/I41S/D60bT/F60eS/Y60gW/D96K/F97D/ins97aA/T98P/F99L/C122S/G151N/Q175L/Q192D | 37 | 44 |

*SEQ ID of the protease domain containing the replacements

Example 7

Cleavage of Proteinase-Activated Receptor 2 (PAR-2)

A. Activity of Mutants in a Proteinase-Activated Receptor 2 Cell-Based Assay

Wild type MTSP-1 is an efficient activator of PAR-2, G-protein-coupled receptor expressed in vascular endothelial cells and a variety of epithelial cells that is involved in inflammatory diseases such as arthritis, lung inflammation (asthma), inflammatory bowel disease, sepsis, and pain disorders. Reduced PAR-2 activity by an anti-C3 variant MTSP-1 polypeptide, therefore, increases C3 selectivity for that engineered protease. Consequently, the modified MTSP-1 polypeptides were tested for their activity (i.e., ability to activate) on the proteinase-activated receptor 2 (PAR-2) in a cell based assay (Millipore). The $ED_{50}$ (nM) of PAR-2 cleavage by the proteases were measured by plotting the fraction cleavage vs. protease concentration on a 4 parameter logistic curve fit (SoftMax Pro software, Molecular Devices, CA). A catalytically inactive version of MTSP-1 was provided as a negative control. Decreased PAR-2 activity in this assay (i.e., a higher $ED_{50}$ for PAR-2 cleavage versus wild type MTSP-1) for a variant MTSP-1 polypeptide indicates that the variant protein displays more restricted specificity than wild type MTSP-1. Increased specificity versus PAR-2 indicates that the variant also can exhibit decreased non-specific cleavage of other proteins compared with wild type MTSP-1. The results of these assays (see Table 20 below) demonstrate that the polypeptides display significantly reduced PAR-2 activity compared with wild type MTSP-1.

Another assay used to mimic the proteolytic activation of PAR-2 in vivo measures the activity of variant MTSP-1 polypeptides on a quenched fluorescence peptidic substrate containing the peptide sequence SKGR↓SL, the P4-P2' sequence (Ser 33 to Leu 38) of the activation cleavage site in PAR-2. Cleavage of R↓S site in this peptidic substrate produces a fluorescence signal allowing measurement of the reaction rate with a fluorescence plate reader. Reduced activity towards the SKGR/SL peptide substrate compared with that of wild type MTSP-1 indicates that the variant MTSP-1 polypeptide possesses enhanced substrate specificity.

Exemplary results are shown in Table 20, below. All tested modified MTSP-1 polypeptides exhibited at least a 30-fold increased $ED_{50}$ and decreased $k_{cat}/K_m$ compared to wild-type MTSP-1 protease domain with the C122c1S replacement set forth in SEQ ID NO: 4. The data indicate that the modified MTSP-1 polypeptides selected for cleavage of C3 have significantly reduced activity for a native substrate.

TABLE 20

| Chymotrypsin numbering | SEQ ID NO.* | SKGR/SL $k_{cat}/K_m$ ($M^{-1}s^{-1}$) | PAR-2 Cell Based Assay $ED_{50}$ (nM) |
|---|---|---|---|
| Wild-type MTSP-1 protease domain with C122S | 4 | 200000 | 1.4 |
| I41R/F97T/Ins97aE/T98G/F99L/C122S/G151N/Q175L/Q192E | 21 | <100 | 2600 |
| Q38H/I41A/D60bV/F60eR/Y60gW/F97T/ins97aE/T98G/F99L/C122S/G151N/Q175L/Q192D | 22 | 925 | 690 |
| Q38H/I41A/D60bT/F60eK/Y60gW/F97T/ins97aE/T98G/F99L/C122S/G151N/Q175L/Q192D | 23 | 245 | 1900 |
| Q38H/I41S/D60bT/F60eS/Y60gW/F97D/ins97aV/T98P/F99L/C122S/G151H/Q175L/Q192E | 24 | 959 | 1800 |
| Q38H/I41S/D60bT/F60eS/Y60gW/F97D/ins97aV/T98P/F99L/C122S/G151H/Q175L/Q192D | 25 | 1730 | 640 |
| Q38H/I41A/D60bT/F60eK/Y60gW/F97T/ins97aE/T98G/F99L/C122S/G151H/Q175L/Q192D | 26 | 742 | 560 |
| Q38H/I41S/D60bT/F60eS/Y60gW/F97D/ins97aV/T98P/F99L/C122S/G151N/Q175L/Q192D | 27 | 1730 | n.d. |
| Q38H/I41A/D60bV/F60eR/Y60gW/F97T/ins97aE/T98G/F99L/C122S/G151H/Q175L/Q192D | 28 | 1360 | 430 |
| Q38H/I41A/D60bV/F60eR/Y60gW/D96I/F97Y/ins97aN/T98G/F99L/C122S/G151N/Q175L/Q192D | 29 | 2320 | 450 |
| Q38H/I41S/D60bT/F60eS/Y60gW/D96K/F97D/ins97aA/T98P/F99L/C122S/G151H/Q175L/Q192D | 30 | 4030 | 420 |
| Q38H/I41A/D60bV/F60eR/Y60gW/D96P/F97W/ins97aN/T98G/F99L/C122S/G151N/Q175L/Q192E | 31 | 1620 | n.d. |
| Q38H/I41A/D60bV/F60eR/Y60gW/D96I/F97N/T98G/F99L/C122S/G151N/Q175L/Q192D | 32 | 3560 | 150 |
| Q38H/I41S/D60bT/F60eS/Y60gW/D96Y/F97E/ins97aV/T98G/F99L/C122S/G151H/Q175L/Q192D | 33 | 865 | n.d. |
| Q38H/I41S/D60bT/F60eS/Y60gW/D96L/F97D/ins97aG/T98N/F99L/C122S/G151H/Q175L/Q192E | 34 | 1300 | n.d. |
| Q38H/I41S/D60bT/F60eS/Y60gW/D96K/F97G/ins97aV/T98P/F99L/C122S/G151H/Q175L/Q192D | 35 | 6210 | n.d. |
| Q38H/I41S/D60bT/F60eS/Y60gW/D96V/F97G/ins97aV/T98P/F99L/C122S/G151H/Q175L/Q192D | 36 | 4990 | n.d. |
| Q38H/I41S/D60bT/F60eS/Y60gW/D96K/F97D/ins97aA/T98P/F99L/C122S/G151N/Q175L/Q192D | 37 | 2060 | n.d. |

*SEQ ID of the protease domain containing the replacements

Example 8

Pharmacokinetic and Pharmacodynamic Activity in Cynomolgus Monkey Vitreous Humor In Vivo The in vivo pharmacodynamic activity in vitreous humor (cynomolgus monkey model) of the modified MTSP-1 polypeptide set forth in SEQ ID NO: 35, which is the protease domain that contains the replacements Q38H/I41S/D60bT/F60eS/Y60gW/D96K/F97G/ins97aV/T98P/F99L/C122S/G151H/Q175L/Q192D, was assessed. The ability to cleave and inactivate C3 in vitreous humor are indicative of a candidate for treatment of AMD.

Twelve naive cynomolgus monkeys were assigned to a single treatment group. Study animals were intravitreally administered a single dose of 125 μg of modified MTSP-1 polypeptide in one eye. The isolated protease domain whose sequence is set forth in SEQ ID NO: 35, which has a molecular weight of approximately 25 kDa, was administered. The right eye received the test article and the left eye was injected with vehicle control. Four animals were sacrificed at each of the following time points: 24 hours post-dose, day 2 and on day 6. Vitreous humor samples were collected from both the right and left eyes and analyzed for modified MTSP-1 polypeptide stability and level of C3 after treatment with modified MTSP-1 polypeptide or vehicle control; C3 and modified MTSP-1 polypeptide concentrations were determined by ELISA as detailed above.

The concentration of the modified MTSP-1 polypeptide present in vitreous humor samples obtained 24 hours post-dose and on day 2, day 6, day 7, and day 28 was measured by ELISA. Proteolytic activity of the MTSP-1 polypeptides (and other serine proteases) in the vitreous samples was quenched by the addition of EGR-CMK (Haematologic Technologies, EGRCK-01) to a final concentration of 10 and the mixture was allowed to stand for 30 minutes at ambient temperature before performing the ELISA.

The half-life of the modified MTSP-1 polypeptide of SEQ ID NO: 35 was determined to be approximately 1.7 days, which corresponds to approximately 5 days in a human system (Deng et al. (2011) *MAbs* 3(1): 61-66). In vivo recovery (i.e., the peak level of modified MSTP-1 polypeptide detected divided by the dose of the modified MTSP-1 polypeptide) of the modified MTSP-1 polypeptide set forth in SEQ ID NO: 35 was calculated by ELISA from the observed maximum level of the modified MTSP-1 polypeptide set forth in SEQ ID NO: 35. The theoretical predicted value for 100% in vivo recovery was 2.5 µM. The measured in vivo recovery of the MTSP-1 protease domain (SEQ ID NO: 35) containing the replacements Q38H/I41S/D60bT/F60eS/Y60gW/D96K/F97G/ins97aV/T98P/F99L/C122S/G151H/Q175L/Q192D was calculated to be approximately 59% of the predicted value, or approximately 1.5 µM. There was substantial variation between two separate experiments (measurement 1=100% and measurement 2=18% recovery), indicating either poor intravitreal injections or inappropriate sample handling, storage, or dilution, and therefore incomplete local delivery of active anti-C3 protease into the vitreous, in the second experiment.

C3 levels in vitreous humor were measured by ELISA. C3 levels in vehicle-injected negative control eye ranged between 0.4 nM-50 nM (2 samples from vehicle-injected eyes differed significantly from the other 10, likely due to blood contamination during harvesting of the vitreous with a needle). The baseline level of C3 prior to MSTP-1 administration was approximately 2.2 nM. C3 was undetectable in the variant-treated eye 1, 2, 6, and 7 days after the single injection of the anti-C3 MTSP polypeptide. 28 days after the single injection, the C3 concentration was approximately 1.4 nM in the eye treated with modified MTSP-1 polypeptide set forth in SEQ ID NO: 35, which is approximately 64% of the baseline level before treatment.

Results show that the modified MTSP-1 polypeptide catalytically eliminates C3. It had a half-life of 1.7 days, as assessed by ELISA and enzyme assays, and suppresses vitreal complement for at least, or longer than, 7 days. Doses of up to 1 mg/eye were well tolerated. PK/PD modeling indicates a suppression of C3 for 3 months or more in humans.

Example 9

Exemplary Mutations at Positions in MTSP-1

Exemplary positions and mutations of MTSP-1 polypeptides, including the full-length, precursor and protease domains and catalytically active portions thereof, are set forth in Table 21 below.

TABLE 21

Exemplary mutations at positions in MTSP-1

| Chymo-trypsin numbering | Mature numbering | WT | SEQ ID NO. 35 | Exemplary mutations | Conservative to Mutations |
|---|---|---|---|---|---|
| 38 | 637 | Q | H | H | N, Q |
| 41 | 640 | I | S | S, R, A, E, D | T, K, Q |
| 59 | 658 | Y |  | F | M, L, Y |
| 60b | 661 | D | T | T, V | S, I, L |
| 60e | 664 | F | S | S, R, K | T, Q, E |
| 60g | 666 | Y | W | W | Y |
| 96 | 705 | D | K | K, V, Y, L, I, P | R, Q, E, W, F |
| 97 | 706 | F | G | G, T, D, E, N, Y, W | P, S, Q, H, F |
| Ins97a |  |  | V | V, E, A, G, N I | L, S, P, Q, H, D |
| 98 | 707 | T | P | P, G, N | Q, H |
| 99 | 708 | F | L | L | I, V |
| 151 | 759 | G | H | H, N | Q |
| 175 | 783 | Q | L | L | I, V |
| 192 | 802 | Q | D | D, E | Q |

The replacements are in any form of MTSP-1, including the protease domain (SEQ ID NO: 2 or 4) and the full length (SEQ ID NO: 1 or 3). The replacements can be combined, including as exemplified herein, including up to as many as 15-18 or more replacements.

Example 10

In Vivo Safety, Tolerability, and Toxicity Studies (Cynomolgus Monkey) of MTSP-1 Variants Following Intravitreal Injection Safety and tolerability of Modified MTSP-1 polypeptides following intravitreal injection were assessed in vivo in cynomolgus monkeys. Three naive cynomolgus monkeys were assigned to each of three treatment groups. Study animals were intravitreally administered either 12.5 µg, 37.5 µg or 125 µg per eye, of each modified MTSP-1 polypeptide. The right eye received the test polypeptide and the left eye was injected with vehicle control. Animals were clinically observed (i.e., food consumption) and ophthalmic examinations were conducted. Ophthalmic examination included slit-lamp biomicroscopy and indirect ophthalmoscope observations, followed by color fundus photography or optical coherence tomography (OCT) prior to dosing (T=0) and on days 2, 8 and 15 post-dosing. All observations continued for up to 4 weeks or until resolution.

The no-observed-adverse-effect-level (NOAEL) was assessed for all animals. The NOAEL for animals administered a modified MTSP-1 polypeptide with the sequence set forth in SEQ ID NO:42 was ≥37.5 µg (equivalent to ≥125 µg/eye in man). No adverse effects were noted for animals administered a modified MTSP-1 polypeptide with the sequence set forth in SEQ ID NO:35; therefore, the NOAEL for animals administered a modified MTSP-1 polypeptide set forth in SEQ ID NO:35 was ≥125 µg (equivalent to ≥375 µg/eye in man).

Example 11

Pharmacodynamic Activity, Safety/Toxicity, and Therapeutic Index Following Intravenous Injection of MTSP-1 Polypeptides The NOAEL following intravenous injection was assessed in a cynomolgus monkey model. The highest non-toxic dose for cynomolgus monkeys administered a modified MTSP-1 polypeptide set forth in SEQ ID NO:35 was ≥4 mg/kg. The $ED_{50}$ for inactivation of circulating C3 was also measured. The C3 activity (i.e., $ED_{50}$ for inactivation of C3) for animals administered a modified MTSP-1 polypeptide set forth in SEQ ID NO:35 was 0.07 mg/kg, which was significantly lower than that of WT MTSP-1. The "therapeutic index" (T.I.) of an anti-C3 MTSP-1 variant polypeptide was defined as the ratio of the NOAEL and the $ED_{50}$ for inactivation of C3 in vivo. The results are set forth in Table 22, below:

TABLE 22

| Chymotrypsin numbering | SEQ ID NO. | C3 destruction $ED_{50}$ (mg/kg) | NOAEL (mg/kg) | Single Bolus T.I. |
|---|---|---|---|---|
| Q38H/I41A/D60bV/F60eR/Y60gW/F97T/ins97aE/ T98G/F99L/C122S/G151N/Q175L/Q192D | 22 | 0.2 | ≥0 | NA |
| Q38H/I41A/D60bT/F60eK/Y60gW/F97T/ins97aE/ T98G/F99L/C122S/G151N/Q175L/Q192D | 23 | 0.2 | ≥4 | ~20 |
| Q38H/I41S/D60bT/F60eS/Y60gW/F97D/ins97aV/ T98P/F99L/C122S/G151H/Q175L/Q192E | 24 | 0.1 | ≥2 | ~20 |
| Q38H/I41A/D60bV/F60eR/Y60gW/D96I/F97Y/ ins97aN/T98G/F99L/C122S/G151N/Q175L/Q192D | 29 | 0.06 | ≥1 | ~17 |
| Q38H/I41S/D60bT/F60eS/Y60gW/D96K/F97G/ ins97aV/T98P/F99L/C122S/G151H/Q175L/Q192D | 35 | 0.07 | ≥4 | >57 |

Example 12

Demonstration that the Modified MTSP-1 Polypeptides Cleave C3 and Inhibit Complement Activation A. Demonstration of the Complement Inhibitory Effect of an Anti-C3 Protease (Sequence ID NO:35) in Human Plasma 1. In Vitro Inhibition of Complement Activation in Human Plasma by the MTSP-1 Variant Polypeptide of Sequence ID NO:35

Studies were performed to assess the anti-complement activity of MTSP-1 polypeptide modified to cleave C3 in human plasma. The test article in these experiments, exemplary of the modified polypeptides described in this application, was the modified MTSP-1 polypeptide of SEQ ID NO:35, which is the protease domain that contains the replacements Q38H/I41S/D60bT/F60eS/Y60gW/D96K/F97G/ins97aV/T98P/F99L/C122S/G151H/Q175L/Q192D. The test article (referred to as test article #1, below), and experimental controls were exposed to the test system, pooled citrated plasma.

The extent of complement inhibition was assessed by measuring inhibition of the standard classical pathway hemolytic assay (CH50). The test citrated plasma was exposed to the test article prior to complement analysis. The extent of complement inhibition is the decrease in hemolytic lysis in the CH50 and C3 Function testing compared with that observed with control (i.e., untreated) citrated plasma. The C3 Function testing allows for analysis of the specific inhibition of the C3 component of the complement cascade.

2. Test Systems

Testing was performed with human citrated plasma pool only (NHS, pools of 3-5 normal individuals).

3. Route of Administration

The test article was added to the test system at a ratio of one part to nine parts (1:9, V:V). This ratio maintains appropriate concentration of the test system so there is sufficient concentration of the complement control proteins. The testing was performed by mixing 450 μL of test system with 50 μL of prepared test article in a 1.5 mL polypropylene microcentrifuge snap cap tube. The mixture was prepared on ice and then vortexed to mix. After all experimental mixtures (positive and negative controls and multiple concentrations of test article) were prepared, they were transferred to a 37° C.±1° C. water bath and incubated for 1 hour±10 minutes. After the mixtures were incubated, if necessary, any particulates were removed by centrifugation, and all samples aliquoted on ice and immediately frozen at −70° C. or below.

4. Test Articles Descriptions

| Test Article | Storage | Concentration | Other Considerations |
|---|---|---|---|
| Test Article #1 | ≤−65° C. | 4 mg/mL 151.6 μM | 100 μL is provided Buffer is PBS |

5. Control Articles

| Positive Control #2 | Source | Storage | Concentration | Other Considerations |
|---|---|---|---|---|
| HAGG (Activator of the Classical Pathway)*1 | Exsera Biolabs | −70° C. | 10 mg/mL | None |

*HAGG—heat activated gamma globulin

| Negative Control #1 | Source | Storage | Concentration | Other Considerations |
|---|---|---|---|---|
| Saline | Exsera Biolabs | 4° C. | 0.9% Saline (154 mmol NaCl) | None |

6. Control and Test Article Preparation

Five concentrations of test article were used with the highest level at 2000 nM. Lower levels were generated with a five-fold serial dilution.

Dilution Table:

| Concentration in test (nM) | 10x Concentration (μM) | Amount of Stock to add (μL) | Which stock | Amount of saline | Total Volume (μL) |
|---|---|---|---|---|---|
| 2000 | 20 | 30 | 151.6 | 200 | 230 |
| 400 | 4 | 40 | 20 | 160 | 200 |

-continued

Dilution Table:

| Concentration in test (nM) | 10x Concentration (µM) | Amount of Stock to add (µL) | Which stock | Amount of saline | Total Volume (µL) |
|---|---|---|---|---|---|
| 80 | 0.8 | 40 | 4 | 160 | 200 |
| 16 | 0.16 | 40 | 0.8 | 160 | 200 |
| 3.2 | 0.032 | 40 | 0.16 | 160 | 200 |

All dilutions to be made with silane unless otherwise indicated

7. Experimental Design & Data

The testing included five concentrations of test article.

| Test or Control Article | Tube Label | Final Concentration (nM unless indicated) |
|---|---|---|
| Test Article #1 | 1-A | 2000 |
|  | 1-B | 400 |
|  | 1-C | 80 |
|  | 1-D | 16 |
|  | 1-E | 3.2 |
| Saline | 11-S | NA |
| Neat (no additive) | 12-N | NA |
| Zymosan | 13-Z | 1 mg/mL |
| HAGG | 14-H | 1 mg/mL |

8. Results

| Test or Control Article | Tube Label | Final Concentration (nM unless indicated) | Data U/mL | % Inhibition |
|---|---|---|---|---|
| Test Article #1 | 1-A | 2000 | 5.56 | 92% |
|  | 1-B | 400 | 10.84 | 84% |
|  | 1-C | 80 | 41.45 | 40% |
|  | 1-D | 16 | 68.97 | 1% |
|  | 1-E | 3.2 | 72.98 | −5% |
| Saline | S | NA | 69.32 |  |
| HAGG | H | 1 mg/mL | 8.16 |  |

These data demonstrate that an anti-C3 MTSP-1 polypeptide (Sequence ID NO:35) effectivity inhibits complement activity in human plasma with 40% inhibition observed at a "dose" of 80 nM anti-C3 MTSP-1 variant (Sequence ID NO:35) and near complete inhibition (i.e., 94%) observed at the highest dose of the MTSP-1 polypeptide used in the studies.

B. Demonstration that Cleavage at the QHAR

-continued

| Test or Control Article | Tube Label | Purified C3 (Y/N) | Test Conditions | Final Concentration in Test Conditions (nM unless indicated) | Expected Outcome |
|---|---|---|---|---|---|
| Test Article #1 | 1-A | Y | Test Condition #1 | 200 | Full C3H50 or midly inhibited |
|  | 1-B | Y |  | 40 |  |
|  | 1-C | Y |  | 8 |  |
| Test Article #1 | 2-A | Y | Test Condition #2 | 200 | Low C3H50 inverse to TA concentration |
|  | 2-B | Y |  | 40 |  |
|  | 2-C | Y |  | 8 |  |
| Neat | N | N | Test Condition #1 | NA |  |
| Zymosan | Z | N | Test Condition #1 | 1 mg/mL |  |
| HAGG | H | N | Test Condition #1 | 1 mg/mL |  |

7. Readout of Complement Activation or Inhibition Modified C3H50 Hemolytic Function.

C3H50 is a measure of the functional activity but with specific emphasis on C3, as it requires the C3 added exogenously. The serum was made deficient in C3. The prepared experimental conditions (conditions 1 and 2) are added to the deficient serum at a 1/50 dilution for the testing. The in-test incubation with the red blood cells was performed at 22° C. for 45 minutes.

8. Results

The results show that inhibition of complement activation, as assessed by hemolytic activity, is mediated by cleavage of C3.

| Test or Control Article | Tube Label | Purified C3 (Y/N) | Test Conditions* | Final Concentration in Test Condition (nM) | Hemolytic Activity (U/mL) |
|---|---|---|---|---|---|
| Saline Only | S | N | Test Condition #1 | NA | 82.43 |
| Saline | SC | Y | Test Condition #2 | NA | 375.81 |
| Test Article #1 | 1-A | Y | Test Condition #1 | 200 | 437.77 |
|  | 1-B | Y |  | 40 | 594.13 |
|  | 1-C | Y |  | 8 | 470.03 |
| Test Article #1 | 2-A | Y | Test Condition #2 | 200 | 73.67 |
|  | 2-B | Y |  | 40 | 97.89 |
|  | 2-C | Y |  | 8 | 295.35 |

*Test condition #1: Incubate components seperately for 2 hours at 37° C. (±2° C.). Then freeze at −80° C. or below until testing in C3H50 (C3 hemolytic activity) with depleted serum (i.e., no pre-cleavage of serum C3).
*Test condition #2: Mix components together with light vortexing and incubate for 2 hours at 37° C. (±2° C.) (i.e., pre-cleavage of serum C3 by the MTSP-1 polypeptide (SEQ. ID. NO.:35).

These data demonstrate that preincubation of C3 with the MTSP-1 variant of Sequence ID NO:35 (that cleaves C3 at the QHAR/ASHL site) substantially inhibits complement activation in human serum. A 1 hour preincubation of human serum with the MTSP-1 variant reduces the hemolytic activity of the serum by approximately 80%.

Example 13

Site Specific Mutagenesis of an Exemplary MTSP-1 Variant to Establish Structure-Activity Relationships for Individual Mutations in MTSP-1

To assess the effect of each replacement, insertion or deletion, site specific mutagenesis was used to create 14 variants of the MTSP-1 variant that contains the modifications Q38H/I41S/D60bT/F60eS/Y60gW/D96K/F97G/ins97aV/T98P/F99L/C122S/G151H/Q175L/Q192D (starting variant). Each of the 14 variants contained a single mutation (compared with the starting variant) in which each single mutated residue in the starting variant (except C122S) was "reverted" (one in each variant) to the corresponding amino acid present in wild type MTSP-1. These variants are shown in FIG. 2 below with reference to the WT MTSP-1 protease domain set forth in SEQ ID NO: 4. Cells with thick borders indicate that the modified MTSP-1 polypeptides at the indicated residue is the same amino acid as the wild-type MTSP-1 polypeptide set forth in SEQ ID NO: 4. Cells with thin borders indicate that the modified MTSP-1 polypeptides contain the same amino acid as the modified MTSP-1 polypeptide set forth in SEQ ID NO: 35.

The anti-C3 activity of each selected variant was assessed by measuring the $ED_{50}$ for C3 cleavage as described above, and the stability of each variant was assessed by measuring the residual enzymatic activity, using the fluorogenic substrate AGR-ACC, after incubation for 7 days in either buffer [Phosphate Buffered Saline (PBS)] or 80% cynomolgus monkey vitreous humor as shown below. These data demonstrate that approximately 50% of the "starting variant" polypeptides exhibit greater activity against C3 in vitreous humor than the reference wild type MTSP-1 protease domain, whose sequence is set forth in SEQ ID NO:4. In addition, 12/14 of the modified MTSP-1 polypeptides are more stable in vitreous humor compared with the reference wild-type protease domain of SEQ ID NO:4, with some showing more stability than others. Therapeutic candidates for ocular indications such as AMD, including those in the table below, are variants that exhibit high C3 cleavage activity and high stability in vitreous humor.

The C3 activity (i.e., $ED_{50}$) of the modified MTSP-1 polypeptides was measured in vitro as described above. The stability of the MTSP-1 polypeptides after incubation for 7 days in either cynomolgus monkey vitreous humor or Phosphate Buffered Saline (PBS) was measured with an activity assay using the fluorogenic substrate AGR-ACC.

TABLE 23

| SEQ ID NO: | Mustation by Chymotrypsin Numbering | | | | | | | | | | | | hC3 cleavage ($ED_{50}$, nM) | MTSP-1 Polypeptide Stability (% Activity) on Day 7 | |
|---|---|---|---|---|---|---|---|---|---|---|---|---|---|---|---|
|  | Q38 | I41 | D60b | F60e | Y60g | D96 | F97 | Ins97a | T98 | F99 | G151 | Q175 | Q192 |  | Vitreous | PBS |
| 5 | Q | I | D | F | Y | D | F |  | T | F | G | Q | Q | 13.6 | 59 | 63 |
| 35 | H | S | T | S | W | K | G | V | P | L | H | L | D | 4.6 | 92 | 94 |
| 47 | Q | S | T | S | W | K | G | V | P | L | H | L | D | 17 | 86 | 87 |
| 48 | H | I | T | S | W | K | G | V | P | L | H | L | D | 205 | 76 | 78 |
| 49 | H | S | D | S | W | K | G | V | P | L | H | L | D | 13 | 87 | 81 |
| 50 | H | S | T | F | W | K | G | V | P | L | H | L | D | 8.7 | 85 | 91 |
| 51 | H | S | T | S | Y | K | G | V | P | L | H | L | D | 22 | 85 | 93 |

TABLE 23-continued

| SEQ ID NO: | Mustation by Chymotrypsin Numbering | | | | | | | | | | | | | hC3 cleavage (ED$_{50}$, nM) | MTSP-1 Polypeptide Stability (% Activity) on Day 7 | |
|---|---|---|---|---|---|---|---|---|---|---|---|---|---|---|---|---|
| | Q38 | I41 | D60b | F60e | Y60g | D96 | F97 | Ins97a | T98 | F99 | G151 | Q175 | Q192 | | Vitreous | PBS |
| 38 | H | S | T | S | W | D | G | V | P | L | H | L | D | 11.9 | 73 | 91 |
| 39 | H | S | T | S | W | K | F | V | P | L | H | L | D | 520 | 77 | 85 |
| 52 | H | S | T | S | W | K | G |   | P | L | H | L | D | 7.9 | 19 | 34 |
| 53 | H | S | T | S | W | K | G | V | T | L | H | L | D | 9.9 | 66 | 82 |
| 54 | H | S | T | S | W | K | G | V | P | F | H | L | D | 18 | 94 | 98 |
| 55 | H | S | T | S | W | K | G | V | P | L | G | L | D | 5.3 | 74 | 87 |
| 56 | H | S | T | S | W | K | G | V | P | L | H | Q | D | 20 | 90 | 94 |
| 40 | H | S | T | S | W | K | G | V | P | L | H | L | Q | 1.6 | 18 | 23 |

The data in the examples and above indicate that the modified MTSP-1 polypeptides cleave human C3 efficiently and maintain 59-94% of this activity after incubation for 7 days in vitreous humor.

For example, the modified MTSP-1 polypeptides cleave human C3 between residues 740 and 741 (SEQ ID NO:9) to thereby inactivate C3:

```
                        Residue no. 737-744
  Q    H    A    R  ↓   A    S    H    L
  P4   P3   P1      ↓   P1'            P4'.
```

Functional consequences of the modified MTSP-1 polypeptides, such as the modified MTSP-1 polypeptides that contain the mutations: Q38H/I41S/D60bT/F60eS/Y60gW/D96K/F97G/ins97aV/T98P/F99L/G151H/Q175L/Q192D or Q38H/I41S/D60bT/F60eS/Y60gW/D96K/F97G/ins97aV/T98P/F99L/C122S/G151H/Q175L/Q192D, where C122S is included to reduce aggregation (see, e.g., SEQ ID NO:35, which sets forth a protease domain of a modified MTSP-1 polypeptides that contains these mutations) are as follows:

Q38H—This mutation increases C3 activity by approximately 3.7-fold.

I41S—This mutation increases anti-C3 activity by approximately 44.6-fold.

D60bT—This mutation increases anti-C3 activity by approximately 2.8-fold.

F60eS—This mutation increases anti-C3 activity by approximately 1.9-fold.

Y60gW—This mutation increases the enzyme's substrate specificity and increases anti-C3 activity by approximately 4.8-fold.

D96K—This mutation increases anti-C3 activity by approximately 2.6-fold.

F97G—This mutation increases anti-C3 activity by approximately 4.3-fold and increases substrate specificity.

Insert 97aV: This mutation increases the modified MTSP-1 polypeptide substrate specificity, increases the modified MTSP-1 polypeptides' stability following 1 week incubation at 37° C. by about 4.8-fold, and increases anti-C3 activity by approximately 1.7-fold.

T98P: This mutation increases the enzyme's stability following 1 week incubation at 37° C. by 1.4-fold and increases anti-C3 activity by approximately 2.2-fold.

F99L: This mutation increases anti-C3 activity by approximately 3.9-fold.

G151H: This mutation increases anti-C3 activity by approximately 1.2-fold.

Q175L: This mutation increases anti-C3 activity by approximately 4.3-fold.

Q192D: This mutation increases stability in vitreous humor following 1 week incubation at 37° C. by 5.1-fold. Among the polypeptides, those containing the mutations Q38H/I41S/D60bT/F60eS/Y60gW/D96K/F97G/ins97aV/T98P/F99L/C122S/G151H/Q175L/Q192D and I41D/C122S/G151N/Q192T are for use for treating DGF and/or AMD.

All residues in the MTSP-1 polypeptides are referenced by chymotrypsin numbering. Unmodified MTSP-1 polypeptides include those of SEQ ID NOs.: 1-4, WT full-length MTSP-1, WT protease domain MTSP-1, WT mature MTSP-1, full-length MTSP-1 with C122S, protease domain MTSP-1 with C122S, mature MTSP-1 with C122S, respectively, where numbering is by chymotrypsin numbering. All modified MTSP-1 polypeptides can include the replacement C122S in place of C122C.

Since modifications will be apparent to those of skill in this art, it is intended that this invention be limited only by the scope of the appended claims.

SEQUENCE LISTING (692 sequences)

SEQ ID NO: 1 - protein, 855 aa, Homo sapiens [sequence omitted]

SEQ ID NO: 2 - protein, 241 aa, Artificial Sequence [sequence omitted]

SEQ ID NO: 3 - protein, 855 aa, Artificial Sequence
  MEMBRANE TYPE SERINE PROTEASE 1 (MT-SP1) pro-peptide     C122S
MGSDRARKGGGGPKDFGAGLKYNSRHEKVNGLEEGVEFLPVNNVKKVEKHGPGRWVVLAAVLIGLLLVLLGIGFLVWHLQYRDVRVQKVFNGYMRITNENFVDAYENSNSTEFVSLASKVKDALKLLYSGVPFLGPYHKESAVTAFSEGSVIAYYWSEFSIPQHLVEEAERVMAEERVVMLPPRARSLKSFVVTSVVAFPTDSKTVQRTQDNSCSFGLHARGVELMRFTTPGFPDSPYPAHARCQWALRGDADSVLSLTFRSFDLASCDERGSDLVTVYNTLSPMEPHALVQLCGTYPPSYNLTFHSSQNVLLITLITNTERRHPGFEATFFQLPRMSSCGGRLRKAQGTFNSPYYPGHYPPNIDCTWNIEVPNNQHVKVRFKFFYLLEPGVPAGTCPKDYVEINGEKYCGERSQFVVTSNSNKITVRFHSDQSYTDTGFLAEYLSYDSSDPCPGQFTCRTGRCIRKELRCDGWADCTDHSDELNCSCDAGHQFTCKNKFCKPLFWVCDSVNDCGDNSDEQGCSCPAQTFRCSNGKCLSKSQQCNGKDDCGDGSDEASCPKVNVVTCTKHTYRCLNGLCLSKGNPECDGKEDCSDGSDEKDCDCGLRSFTRQARVVGGTDADEGEWPWQVSLHALGQGHICGASLISPNWLVSAAHCYIDDRGFRYSDPTQWTAFLGLHDQSQRSAPGVQERRLKRIISHPFFNDFTFDYDIALLELEKPAEYSSMVRPISLPDASHVFPAGKAIWVTGWGHTQYGGTGALILQKGEIRVINQTTCENLLPQQITPRMMCVGFLSGGVDSCQGDSGGPLSSVEADGRIFQAGVVSWGDGCAQRNKPGVYTRLPLFRDWIKENTGV

SEQ ID NO: 4 - protein, 241 aa, Artificial Sequence [sequence omitted]

SEQ ID NO: 5 - DNA, 3149 bp, Homo sapiens
gacgcctgtgagacccgcgagcggcctcggggaccatggggagcgatcgggcccgcaagggcggagggggcccgaaggacttcggcgcgggactcaagtacaactcccggcacgagaaagtgaatggcttggaggaaggcgtggagttcctgccagtcaacaacgtcaagaaggtggaaaagcatggcccggggcgctgggtggtgctggcagccgtgctgatcggcctcctcttggtcttgctggggatcggcttcctggtgtggcatttgcagtaccgggacgtgcgtgtccagaaggtcttcaatggctacatgaggatcacaaatgagaattttgtggatgcctacgagaactccaactccactgagtttgtaagcctggccagcaaggtgaaggacgcgctgaagctgctgtacagcggagtcccattcctgggcccctaccacaaggagtcggctgtgacggccttcagcgagggcagcgtcatcgcctactactggtctgagttcagcatcccgcagcacctggtggaggaggccgagcgcgtcatggccgaggagcgcgtagtcatgctgcccccgcgggcgcgctccctgaagtcctttgtggtcacctcagtggtggctttccccacggactccaaaacagtacagaggacccaggacaacagctgcagctttggcctgcacgcccgcggtgtggagctgatgcgcttcaccacgcccggcttccctgacagcccctaccccgctcatgcccgctgccagtgggccctgcggggggacgccgactcagtgctgagcctcaccttccgcagctttgaccttgcgtcctgcgacgagcgcggcagcgacctggtgacggtgtacaacaccctgagccccatggagccccacgccctggtgcagttgtgtggcacctaccctccctcctacaacctgaccttccactcctcccagaacgtcctgctcatcacactgataaccaacactgagcggcggcatcccggctttgaggccaccttcttccagctgcctaggatgagcagctgtggaggccgcttacgtaaagcccaggggacattcaacagcccctactacccaggccactacccacccaacattgactgcacatggaacattgaggtgcccaacaaccagcatgtgaaggtgcgcttcaaattcttctacctgctggagcccggcgtgcctgcgggcacctgccccaaggactacgtggagatcaatggggagaaatactgcggagagaggtcccagttcgtcgtcaccagcaacagcaacaagatcacagttcgcttccactcagatcagtcctacaccgacaccggcttcttagctgaatacctctcctacgactccagtgacccatgcccggggcagttcacgtgccgcacggggcggtgtatccggaaggagctgcgctgtgatggctgggccgactgcaccgaccacagcgatgagctcaactgcagttgcgacgccggccaccagttcacgtgcaagaacaagttctgcaagcccctcttctgggtctgcgacagtgtgaacgactgcggagacaacagcgacgagcaggggtgcagttgtccggcccagaccttcaggtgttccaatgggaagtgcctctcgaaaagccagcagtgcaatgggaaggacgactgtggggacgggtccgacgaggcctcctgccccaaggtgaacgtcgtcacttgtaccaaacacacctaccgctgcctcaatgggctctgcttgagcaagggcaaccctgagtgtgacgggaaggaggactgtagcgacggctcagatgagaaggactgcgactgtgggctgcggtcattcacgagacaggctcgtgttgttgggggcacggatgcggatgagggcgagtggccctggcaggtaagcctgcatgctctgggccagggccacatctgcggtgcttccctcatctctcccaactggctggtctctgccgcacactgctacatcgatgacagaggattcaggtactcagaccccacgcagtggacggccttcctgggcttgcacgaccagagccagcgcagcgcccctggggtgcaggagcgcaggctcaagcgcatcatctcccaccccttcttcaatgacttcaccttcgactatgacatcgcgctgctggagctggagaaaccggcagagtacagctccatggtgcggcccatctgcctgccggacgcctcccatgtcttccctgccggcaaggccatctgggtcacgggctggggacacacccagtatggaggcactggcgcgctgatcctgcaaaagggtgagatccgcgtcatcaaccagaccacctgcgagaacctcctgccgcagcagatcacgccgcgcatgatgtgcgtgggcttcctcagcggcggcgtggactcctgccagggtgattccgggggacccctgtccagcgtggaggcggatgggcggatcttccaggccggtgtggtgagctggggagacggctgcgctcagaggaacaagccaggcgtgtacacaaggctccctctgtttcgggactggatcaaagagaacactggggtataggggccggggccacccaaatgtgtacacctgcggggccacccatcgtccaccccagtgtgcacgcctgcaggctggagactggaccgctgactgcaccagcgcccccagaacatacactgtgaactcaatctccagggctccaaatctgcctagaaaacctctcgcttcctcagcctccaaagtggagctgggaggtagaaggggaggacactggtggttctactgacccaactgggggcaaaggtttgaagacacagcctcccccgccagccccaagctgggccgaggcgcgtttgtgtatatctgcctcccctgtctgtaaggagcagcgggaacggagcttcggagcctcctcagtgaaggtggtggggctgccggatctgggctgtggggcccttgggccacgctcttgaggaagcccaggctcggaggaccctggaaaacagacgggtctgagactgaaaatggtttaccagctcccaggtgacttcagtgtgtgtattgtgtaaatgagtaaaacattttatttctttttaaaaaaaaaaa

SEQ ID NO: 6 - protein, 241 aa, Artificial Sequence
  MEMBRANE TYPE SERINE PROTEASE 1 (MT-SP1) protease domain I41T/F97L/F99L/C122S/G151N/Q175S/Q192S/D217W
VVGGTDADEGEWPWQVSLHALGQGHTCGASLISPNWLVSAAHCYIDDRGFRYSDPTQWTAFLGLHDQSQRSAPGVQERRLKRIISHPFFNDLTLDYDIALLELEKPAEYSSMVRPISLPDASHVFPAGKAIWVTGWGHTQYGGTNALILQKGEIRVINQTTCENLLPQSITPRMMCVGFLSGGVDSCSGDSGGPLSSVEADGRIFQAGVVSWGWGCAQRNKPGVYTRLPLFRDWIKENTGV

SEQ ID NO: 7 - DNA, 723 bp, Artificial Sequence
  MEMBRANE TYPE SERINE PROTEASE 1 (MT-SP1) protease domain
gttgttgggggcacggatgcggatgagggcgagtggccctggcaggtaagcctgcatgctctgggccagggccacatctgcggtgcttccctcatctctcccaactggctggtctctgccgcacactgctacatcgatgacagaggattcaggtactcagaccccacgcagtggacggccttcctgggcttgcacgaccagagccagcgcagcgcccctggggtgcaggagcgcaggctcaagcgcatcatctcccaccccttcttcaatgacttcaccttcgactatgacatcgcgctgctggagctggagaaaccggcagagtacagctccatggtgcggcccatctgcctgccggacgcctcccatgtcttccctgccggcaaggccatctgggtcacgggctggggacacacccagtatggaggcactggcgcgctgatcctgcaaaagggtgagatccgcgtcatcaaccagaccacctgcgagaacctcctgccgcagcagatcacgccgcgcatgatgtgcgtgggcttcctcagcggcggcgtggactcctgccagggtgattccgggggacccctgtccagcgtggaggcggatgggcggatcttccaggccggtgtggtgagctggggagacggctgcgctcagaggaacaagccaggcgtgtacacaaggctccctctgtttcgggactggatcaaagagaacactggggta

SEQ ID NO: 8 - protein, 241 aa, Artificial Sequence
  MEMBRANE TYPE SERINE PROTEASE 1 (MT-SP1) protease domain    I41D/F97T/F99M/C122S/Q192V/D217M
VVGGTDADEGEWPWQVSLHALGQGHDCGASLISPNWLVSAAHCYIDDRGFRYSDPTQWTAFLGLHDQSQRSAPGVQERRLKRIISHPFFNDTTMDYDIALLELEKPAEYSSMVRPISLPDASHVFPAGKAIWVTGWGHTQYGGTGALILQKGEIRVINQTTCENLLPQQITPRMMCVGFLSGGVDSCVGDSGGPLSSVEADGRIFQAGVVSWGMGCAQRNKPGVYTRLPLFRDWIKENTGV

SEQ ID NO: 9 - protein, 1663 aa, Artificial Sequence
  Complement Protein C3
MGPTSGPSLLLLLLTHLPLALGSPMYSIITPNILRLESEETMVLEAHDAQGDVPVTVTVHDFPGKKLVLSSEKTVLTPATNHMGNVTFTIPANREFKSEKGRNKFVTVQATFGTQVVEKVVLVSLQSGYLFIQTDKTIYTPGSTVLYRIFTVNHKLLPVGRTVMVNIENPEGIPVKQDSLSSQNQLGVLPLSWDIPELVNMGQWKIRAYYENSPQQVFSTEFEVKEYVLPSFEVIVEPTEKFYYIYNEKGLEVTITARFLYGKKVEGTAFVIFGIQDGEQRISLPESLKRIPIEDGSGEVVLSRKVLLDGVQNPRAEDLVGKSLYVSATVILHSGSDMVQAERSGIPIVTSPYQIHFTKTPKYFKPGMPFDLMVFVTNPDGSPAYRVPVAVQGEDTVQSLTQGDGVAKLSINTHPSQKPLSITVRTKKQELSEAEQATRTMQALPYSTVGNSNNYLHLSVLRTELRPGETLNVNFLLRMDRAHEAKIRYYTYLIMNKGRLLKAGRQVREPGQDLVVLPLSITTDFIPSFRLVAYYTLIGASGQREVVADSVWVDVKDSCVGSLVVKSGQSEDRQPVPGQQMTLKIEGDHGARVVLVAVDKGVFVLNKKNKLTQSKIWDVVEKADIGCTPGSGKDYAGVFSDAGLTFTSSSGQQTAQRAELQCPQPAARRRRSVQLTEKRMDKVGKYPKELRKCCEDGMRENPMRFSCQRRTRFISLGEACKKVFLDCCNYITELRRQHARASHLGLARSNLDEDIIAEENIVSRSEFPESWLWNVEDLKEPPKNGISTKLMNIFLKDSITTWEILAVSMSDKKGICVADPFEVTVMQDFFIDLRLPYSVVRNEQVEIRAVLYNYRQNQELKVRVELLHNPAFCSLATTKRRHQQTVTIPPKSSLSVPYVIVPLKTGLQEVEVKAAVYHHFISDGVRKSLKVVPEGIRMNKTVAVRTLDPERLGREGVQKEDIPPADLSDQVPDTESETRILLQGTPVAQMTEDAVDAERLKHLIVTPSGCGEQNMIGMTPTVIAVHYLDETEQWEKFGLEKRQGALELIKKGYTQQLAFRQPSSAFAAFVKRAPSTWLTAYVVKVFSLAVNLIAIDSQVLCGAVKWLILEKQKPDGVFQEDAPVIHQEMIGGLRNNNEKDMALTAFVLISLQEAKDICEEQVNSLPGSITKAGDFLEANYMNLQRSYTVAIAGYALAQMGRLKGPLLNKFLTTAKDKNRWEDPGKQLYNVEATSYALLALLQLKDFDFVPPVVRWLNEQRYYGGGYGSTQATFMVFQALAQYQKDAPDHQELNLDVSLQLPSRSSKITHRIHWESASLLRSEETKENEGFTVTAEGKGQGTLSVVTMYHAKAKDQLTCNKFDLKVTIKPAPETEKRPQDAKNTMILEICTRYRGDQDATMSILDISMMTGFAPDTDDLKQLANGVDRYISKYELDKAFSDRNTLIIYLDKVSHSEDDCLAFKVHQYFNVELIQPGAVKVYAYYNLEESCTRFYHPEKEDGKLNKLCRDELCRCAEENCFIQKSDDKVTLEERLDKACEPGVDYVYKTRLVKVQLSNDFDEYIMAIEQTIKSGSDEVQVGQQRTFISPIKCREALKLEEKKHYLMWGLSSDFWGEKPNLSYIIGKDTWVEHWPEEDECQDEENQKQCQDLGAFTESMVVFGCPN

SEQ ID NO: 10 - DNA, 5132 bp, Artificial Sequence
  Complement Protein C3
agataaaaagccagctccagcaggcgctgctcactcctccccatcctctccctctgtccctctgtccctctgaccctgcactgtcccagcaccatgggacccacctcaggtcccagcctgctgctcctgctactaacccacctccccctggctctggggagtcccatgtactctatcatcacccccaacatcttgcggctggagagcgaggagaccatggtgctggaggcccacgacgcgcaaggggatgttccagtcactgttactgtccacgacttcccaggcaaaaaactagtgctgtccagtgagaagactgtgctgacccctgccaccaaccacatgggcaacgtcaccttcacgatcccagccaacagggagttcaagtcagaaaaggggcgcaacaagttcgtgaccgtgcaggccaccttcgggacccaagtggtggagaaggtggtgctggtcagcctgcagagcgggtacctcttcatccagacagacaagaccatctacacccctggctccacagttctctatcggatcttcaccgtcaaccacaagctgctacccgtgggccggacggtcatggtcaacattgagaacccggaaggcatcccggtcaagcaggactccttgtcttctcagaaccagcttggcgtcttgcccttgtcttgggacattccggaactcgtcaacatgggccagtggaagatccgagcctactatgaaaactcaccacagcaggtcttctccactgagtttgaggtgaaggagtacgtgctgcccagtttcgaggtcatagtggagcctacagagaaattctactacatctataacgagaagggcctggaggtcaccatcaccgccaggttcctctacgggaagaaagtggagggaactgcctttgtcatcttcgggatccaggatggcgaacagaggatttccctgcctgaatccctcaagcgcattccgattgaggatggctcgggggaggttgtgctgagccggaaggtactgctggacggggtgcagaacccccgagcagaagacctggtggggaagtctttgtacgtgtctgccaccgtcatcttgcactcaggcagtgacatggtgcaggcagagcgcagcgggatccccatcgtgacctctccctaccagatccacttcaccaagacacccaagtacttcaaaccaggaatgccctttgacctcatggtgttcgtgacgaaccctgatggctctccagcctaccgagtccccgtggcagtccagggcgaggacactgtgcagtctctaacccagggagatggcgtggccaaactcagcatcaacacacaccccagccagaagcccttgagcatcacggtgcgcacgaagaagcaggagctctcggaggcagagcaggctaccaggaccatgcaggctctgccctacagcaccgtgggcaactccaacaattacctgcatctctcagtgctacgtacagagctcagacccggggagaccctcaacgtcaacttcctcctgcgaatggaccgcgcccacgaggccaagatccgctactacacctacctgatcatgaacaagggcaggctgttgaaggcgggacgccaggtgcgagagcccggccaggacctggtggtgctgcccctgtccatcaccaccgacttcatcccttccttccgcctggtggcgtactacacgctgatcggtgccagcggccagagggaggtggtggccgactccgtgtgggtggacgtcaaggactcctgcgtgggctcgctggtggtaaaaagcggccagtcagaagaccggcagcctgtacctgggcagcagatgaccctgaagatagagggtgaccacggggcccgggtggtactggtggccgtggacaagggcgtgttcgtgctgaataagaagaacaaactgacgcagagtaagatctgggacgtggtggagaaggcagacatcggctgcaccccgggcagtgggaaggattacgccggtgtcttctccgacgcagggctgaccttcacgagcagcagtggccagcagaccgcccagagggcagaacttcagtgcccgcagccagccgcccgccgacgccgttccgtgcagctcacggagaagcgaatggacaaagtcggcaagtaccccaaggagctgcgcaagtgctgcgaggacggcatgcgggagaaccccatgaggttctcgtgccagcgccggacccgtttcatctccctgggcgaggcgtgcaagaaggtcttcctggactgctgcaactacatcacagagctgcggcggcagcacgcgcgggccagccacctgggcctggccaggagtaacctggatgaggacatcattgcagaagagaacatcgtttcccgaagtgagttcccagagagctggctgtggaacgttgaggacttgaaagagccaccgaaaaatggaatctctacgaagctcatgaatatatttttgaaagactccatcaccacgtgggagattctggctgtgagcatgtcggacaagaaagggatctgtgtggcagaccccttcgaggtcacagtaatgcaggacttcttcatcgacctgcggctaccctactctgttgttcgaaacgagcaggtggaaatccgagccgttctctacaattaccggcagaaccaagagctcaaggtgagggtggaactactccacaatccagccttctgcagcctggccaccaccaagaggcgtcaccagcagaccgtaaccatcccccccaagtcctcgttgtccgttccatatgtcatcgtgccgctaaagaccggcctgcaggaagtggaagtcaaggctgctgtctaccatcatttcatcagtgacggtgtcaggaagtccctgaaggtcgtgccggaaggaatcagaatgaacaaaactgtggctgttcgcaccctggatccagaacgcctgggccgtgaaggagtgcagaaagaggacatcccacctgcagacctcagtgaccaagtcccggacaccgagtctgagaccagaattctcctgcaagggaccccagtggcccagatgacagaggatgccgtcgacgcggaacggctgaagcacctcattgtgaccccctcgggctgcggggaacagaacatgatcggcatgacgcccacggtcatcgctgtgcattacctggatgaaacggagcagtgggagaagttcggcctagagaagcggcagggggccttggagctcatcaagaaggggtacacccagcagctggccttcagacaacccagctctgcctttgcggccttcgtgaaacgggcacccagcacctggctgaccgcctacgtggtcaaggtcttctctctggctgtcaacctcatcgccatcgactcccaagtcctctgcggggctgttaaatggctgatcctggagaagcagaagcccgacggggtcttccaggaggatgcgcccgtgatacaccaagaaatgattggtggattacggaacaacaacgagaaagacatggccctcacggcctttgttctcatctcgctgcaggaggctaaagatatttgcgaggagcaggtcaacagcctgccaggcagcatcactaaagcaggagacttccttgaagccaactacatgaacctacagagatcctacactgtggccattgctggctatgctctggcccagatgggcaggctgaaggggcctcttcttaacaaatttctgaccacagccaaagataagaaccgctgggaggaccctggtaagcagctctacaacgtggaggccacatcctatgccctcttggccctactgcagctaaaagactttgactttgtgcctcccgtcgtgcgttggctcaatgaacagagatactacggtggtggctatggctctacccaggccaccttcatggtgttccaagccttggctcaataccaaaaggacgcccctgaccaccaggaactgaaccttgatgtgtccctccaactgcccagccgcagctccaagatcacccaccgtatccactgggaatctgccagcctcctgcgatcagaagagaccaaggaaaatgagggtttcacagtcacagctgaaggaaaaggccaaggcaccttgtcggtggtgacaatgtaccatgctaaggccaaagatcaactcacctgtaataaattcgacctcaaggtcaccataaaaccagcaccggaaacagaaaagaggcctcaggatgccaagaacactatgatccttgagatctgtaccaggtaccggggagaccaggatgccactatgtctatattggacatatccatgatgactggctttgctccagacacagatgacctgaagcagctggccaatggtgttgacagatacatctccaagtatgagctggacaaagccttctccgataggaacaccctcatcatctacctggacaaggtctcacactctgaggatgactgtctagctttcaaagttcaccaatactttaatgtagagcttatccagcctggagcagtcaaggtctacgcctattacaacctggaggaaagctgtacccggttctaccatccggaaaaggaggatggaaagctgaacaagctctgccgtgatgaactgtgccgctgtgctgaggagaattgcttcatacaaaagtcggatgacaaggtcaccctggaagaacggctggacaaggcctgtgagccaggagtggactatgtgtacaagacccgactggtcaaggttcagctgtccaatgactttgacgagtacatcatggccattgagcagaccatcaagtcaggctcggatgaggtgcaggttggacagcagcgcacgttcatcagccccatcaagtgcagagaagccctgaagctggaggagaagaaacactacctcatgtggggtctctcctccgatttctggggagagaagcccaacctcagctacatcatcgggaaggacacttgggtggagcactggcccgaggaggacgaatgccaagacgaagagaaccagaaacaatgccaggacctcggcgccttcaccgagagcatggttgtctttgggtgccccaactgaccacacccccattcccccactccagataaagcttcagttatatctca

SEQ ID NO: 11 - protein, 855 aa, Artificial Sequence [sequence omitted]

SEQ ID NO: 12 - protein, 855 aa, Mus musculus
MGSNRGRKAGGGSQDFGAGLKYNSRLENMNGFEEGVEFLPANNAKKVEKRGPRRWVVLVAVLFSFLLLSLMAGLLVWHFHYRNVRVQKVFNGHLRITNEIFLDAYENSTSTEFISLASQVKEALKLLYNEVPVLGPYHKKSAVTAFSEGSVIAYYWSEFSIPPHLAEEVDRAMAVERVVTLPPRARALKSFVLTSVVAFPIDPRMLQRTQDNSCSFALHAHGAAVTRFTTPGFPNSPYPAHARCQWVLRGDADSVLSLTFRSFDVAPCDEHGSDLVTVYDSLSPMEPHAVVRLCGTFSPSYNLTFLSSQNVFLVTLITNTDRRHPGFEATFFQLPKMSSCGGFLSDTQGTFSSPYYPGHYPPNINCTWNIKVPNNRNVKVRFKLFYLVDPNVPVGSCTKDYVEINGEKYCGERSQFVVSSNSSKITVHFHSDHSYTDTGFLAEYLSYDSNDPCPGMFMCKTGRCIRKELRCDGWADCPDYSDERYCRCNATHQFTCKNQFCKPLFWVCDSVNDCGDGSDEEGCSCPAGSFKCSNGKCLPQSQKCNGKDNCGDGSDEASCDSVNVVSCTKYTYRCQNGLCLSKGNPECDGKTDCSDGSDEKNCDCGLRSFTKQARVVGGTNADEGEWPWQVSLHALGQGHLCGASLISPDWLVSAAHCFQDDKNFKYSDYTMWTAFLGLLDQSKRSASGVQELKLKRIITHPSFNDFTFDYDIALLELEKSVEYSTVVRPICLPDATHVFPAGKAIWVTGWGHTKEGGTGALILQKGEIRVINQTTCEDLMPQQITPRMMCVGFLSGGVDSCQGDSGGPLSSAEKDGRMFQAGVVSWGEGCAQRNKPGVYTRLPVVRDWIKEHTGV

SEQ ID NO: 13 - protein, 855 aa, Rattus norvegicus
MGNNRGRKAGGGSQDFGAGLKYNSRLENMNGFEEGVEFLPVNNAKQVEKRGPRRWVVMVAVVFSFLLLSLMAGLLVWHFHYRNVRIQKVFNGHLRITNENFLDAYENSTSTEFISLASQVKEALKLMYSEVPVLGPYHKKSTVTAFSEGSVIAYYWSEFSIPPHLEEEVDRAMAVERVVTLPPRARALKSFVLTSVVAFPIDPRMLQRTQDNSCSFALHARGRTVTRFTTPGFPNSPYPAHARCQWVLRGDADSVLSLTFRSFDVAPCDGHDSDLVTVYDSLSPMEPHAVVRLCGTFSPSYNLTFLSSQNVFLVTLITNTDRRHPGFEATFFQLPKMSSCGGLLSEAQGTFSSPYYPGHYPPNINCTWNIKVPNNRNVKVRFKLFYLVDPNIPVGSCTKDYVEINGEKFCGERSQFVVSSNSSKITVHFHSDHSYTDTGFLAEYLSYDSNDPCPGMFMCKTGRCIRKDLRCDGWADCPDYSDERHCRCNATHQFMCKNQFCKPLFWVCDSVNDCGDGSDEEGCSCPAGSFKCSNGKCLPQSQQCNGKDDCGDGSDEASCDNVNAVSCTKYTYRCQNGLCLNKGNPECDGKKDCSDGSDEKNCDCGLRSFTKQARVVGGTNADEGEWPWQVSLHALGQGHLCGASLISPDWLVSAAHCFQDETIFKYSDHTMWTAFLGLLDQSKRSASGVQEHKLKRIITHPSFNDFTFDYDIALLELEKPAEYSTVVRPICLPDNTHVFPAGKAIWVTGWGHTKEGGTGALILQKGEIRVINQTTCEELLPQQITPRMMCVGFLSGGVDSCQGDSGGPLSSVEKDGRIFQAGVVSWGEGCAQRNKPGVYTRIPEVRDWIKEQTGV

SEQ ID NO: 14 - protein, 263 aa, Artificial Sequence
  chymotrypsin B
MAFLWLLSCWALLGTTFGCGVPAIHPVLSGLSRIVNGEDAVPGSWPWQVSLQDKTGFHFCGGSLISEDWVVTAAHCGVRTSDVVVAGEFDQGSDEENIQVLKIAKVFKNPKFSILTVNNDITLLKLATPARFSQTVSAVCLPSADDDFPAGTLCATTGWGKTKYNANKTPDKLQQAALPLLSNAECKKSWGRRITDVMICAGASGVSSCMGDSGGPLVCQKDGAWTLVGIVSWGSDTCSTSSPGVYARVTKLIPWVQKILAAN

SEQ ID NO: 15 - DNA, 865 bp, Artificial Sequence
  chymotrypsin B
ccctgccagcggcaccatggctttcctctggctcctctcctgctgggccctcctgggtaccaccttcggctgcggggtccccgccatccaccctgtgctcagcggcctgtccaggatcgtgaatggggaggacgccgtccccggctcctggccctggcaggtgtccctgcaggacaaaaccggcttccacttctgcgggggctccctcatcagcgaggactgggtggtcaccgctgcccactgcggggtcaggacctccgacgtggtcgtggctggggagtttgaccagggctctgacgaggagaacatccaggtcctgaagatcgccaaggtcttcaagaaccccaagttcagcattctgaccgtgaacaatgacatcaccctgctgaagctggccacacctgcccgcttctcccagacagtgtccgccgtgtgcctgcccagcgccgacgacgacttccccgcggggacactgtgtgccaccacaggctggggcaagaccaagtacaacgccaacaagacccctgacaagctgcagcaggcagccctgcccctcctgtccaatgccgaatgcaagaagtcctggggcaggaggatcaccgacgtgatgatctgtgccggggccagtggcgtctcctcctgcatgggcgactctggcggtcccctggtctgccaaaaggatggagcctggaccctggtgggcattgtgtcctggggcagcgacacctgctccacctccagccctggcgtgtacgcccgtgtcaccaagctcataccttgggtgcagaagatcctggctgccaactgagcccgcggctccctccgaccctgctccccacagagcctcagtaaacccatggaacac

SEQ ID NO: 16 - protein, 1637 aa, Artificial Sequence
  Complement Protein C3: mature 2 chain
SPMYSIITPNILRLESEETMVLEAHDAQGDVPVTVTVHDFPGKKLVLSSEKTVLTPATNHMGNVTFTIPANREFKSEKGRNKFVTVQATFGTQVVEKVVLVSLQSGYLFIQTDKTIYTPGSTVLYRIFTVNHKLLPVGRTVMVNIENPEGIPVKQDSLSSQNQLGVLPLSWDIPELVNMGQWKIRAYYENSPQQVFSTEFEVKEYVLPSFEVIVEPTEKFYYIYNEKGLEVTITARFLYGKKVEGTAFVIFGIQDGEQRISLPESLKRIPIEDGSGEVVLSRKVLLDGVQNPRAEDLVGKSLYVSATVILHSGSDMVQAERSGIPIVTSPYQIHFTKTPKYFKPGMPFDLMVFVTNPDGSPAYRVPVAVQGEDTVQSLTQGDGVAKLSINTHPSQKPLSITVRTKKQELSEAEQATRTMQALPYSTVGNSNNYLHLSVLRTELRPGETLNVNFLLRMDRAHEAKIRYYTYLIMNKGRLLKAGRQVREPGQDLVVLPLSITTDFIPSFRLVAYYTLIGASGQREVVADSVWVDVKDSCVGSLVVKSGQSEDRQPVPGQQMTLKIEGDHGARVVLVAVDKGVFVLNKKNKLTQSKIWDVVEKADIGCTPGSGKDYAGVFSDAGLTFTSSSGQQTAQRAELQCPQPAASVQLTEKRMDKVGKYPKELRKCCEDGMRENPMRFSCQRRTRFISLGEACKKVFLDCCNYITELRRQHARASHLGLARSNLDEDIIAEENIVSRSEFPESWLWNVEDLKEPPKNGISTKLMNIFLKDSITTWEILAVSMSDKKGICVADPFEVTVMQDFFIDLRLPYSVVRNEQVEIRAVLYNYRQNQELKVRVELLHNPAFCSLATTKRRHQQTVTIPPKSSLSVPYVIVPLKTGLQEVEVKAAVYHHFISDGVRKSLKVVPEGIRMNKTVAVRTLDPERLGREGVQKEDIPPADLSDQVPDTESETRILLQGTPVAQMTEDAVDAERLKHLIVTPSGCGEQNMIGMTPTVIAVHYLDETEQWEKFGLEKRQGALELIKKGYTQQLAFRQPSSAFAAFVKRAPSTWLTAYVVKVFSLAVNLIAIDSQVLCGAVKWLILEKQKPDGVFQEDAPVIHQEMIGGLRNNNEKDMALTAFVLISLQEAKDICEEQVNSLPGSITKAGDFLEANYMNLQRSYTVAIAGYALAQMGRLKGPLLNKFLTTAKDKNRWEDPGKQLYNVEATSYALLALLQLKDFDFVPPVVRWLNEQRYYGGGYGSTQATFMVFQALAQYQKDAPDHQELNLDVSLQLPSRSSKITHRIHWESASLLRSEETKENEGFTVTAEGKGQGTLSVVTMYHAKAKDQLTCNKFDLKVTIKPAPETEKRPQDAKNTMILEICTRYRGDQDATMSILDISMMTGFAPDTDDLKQLANGVDRYISKYELDKAFSDRNTLIIYLDKVSHSEDDCLAFKVHQYFNVELIQPGAVKVYAYYNLEESCTRFYHPEKEDGKLNKLCRDELCRCAEENCFIQKSDDKVTLEERLDKACEPGVDYVYKTRLVKVQLSNDFDEYIMAIEQTIKSGSDEVQVGQQRTFISPIKCREALKLEEKKHYLMWGLSSDFWGEKPNLSYIIGKDTWVEHWPEEDECQDEENQKQCQDLGAFTESMVVFGCPN

SEQ ID NO: 17 - protein, 4 aa, Artificial Sequence
  C3 convertase cleavage site 748-749
GLAR

SEQ ID NO: 18 - protein, 4 aa, Artificial Sequence
  Factor I cleavage site 954-955
RLGR

SEQ ID NO: 19 - protein, 4 aa, Artificial Sequence
  Factor I cleavage site 1303-1304
LPSR

SEQ ID NO: 20 - protein, 4 aa, Artificial Sequence
  Factor I cleavage site 1320-1321
SLLR

SEQ ID NO: 21 - protein, 242 aa, Artificial Sequence
  MEMBRANE TYPE SERINE PROTEASE 1 (MT-SP1) protease domain I41R/F97T/Ins97aE/T98G/F99L/C122S/G151N/Q175L/Q192 E
VVGGTDADEGEWPWQVSLHALGQGHRCGASLISPNWLVSAAHCYIDDRGFRYSDPTQWTAFLGLHDQSQRSAPGVQERRLKRIISHPFFNDTEGLDYDIALLELEKPAEYSSMVRPISLPDASHVFPAGKAIWVTGWGHTQYGGTNALILQKGEIRVINQTTCENLLPQLITPRMMCVGFLSGGVDSCEGDSGGPLSSVEADGRIFQAGVVSWGDGCAQRNKPGVYTRLPLFRDWIKENTGV

SEQ ID NO: 22 - protein, 242 aa, Artificial Sequence
  MEMBRANE TYPE SERINE PROTEASE 1 (MT-SP1) protease domain Q38H/I41A/D60bV/F60eR/Y60gW/F97T/ins97aE/T98G/F99L /C122S/G151N/Q175L/Q192D
VVGGTDADEGEWPWQVSLHALGHGHACGASLISPNWLVSAAHCYIDVRGRRWSDPTQWTAFLGLHDQSQRSAPGVQERRLKRIISHPFFNDTEGLDYDIALLELEKPAEYSSMVRPISLPDASHVFPAGKAIWVTGWGHTQYGGTNALILQKGEIRVINQTTCENLLPQLITPRMMCVGFLSGGVDSCDGDSGGPLSSVEADGRIFQAGVVSWGDGCAQRNKPGVYTRLPLFRDWIKENTGV

SEQ ID NO: 23 - protein, 242 aa, Artificial Sequence
  MEMBRANE TYPE SERINE PROTEASE 1 (MT-SP1) protease domain Q38H/I41A/D60bT/F60eK/Y60gW/F97T/ins97aE/T98G/F99L /C122S/G151N/Q175L/Q192D
VVGGTDADEGEWPWQVSLHALGHGHACGASLISPNWLVSAAHCYIDTRGKRWSDPTQWTAFLGLHDQSQRSAPGVQERRLKRIISHPFFNDTEGLDYDIALLELEKPAEYSSMVRPISLPDASHVFPAGKAIWVTGWGHTQYGGTNALILQKGEIRVINQTTCENLLPQLITPRMMCVGFLSGGVDSCDGDSGGPLSSVEADGRIFQAGVVSWGDGCAQRNKPGVYTRLPLFRDWIKENTGV

SEQ ID NO: 24 - protein, 242 aa, Artificial Sequence
  MEMBRANE TYPE SERINE PROTEASE 1 (MT-SP1) protease Q38H/I41S/D60bT/F60eS/Y60gW/F97D/ins97aV/T98P/F99L /C122S/G151H/Q175L/Q192E
VVGGTDADEGEWPWQVSLHALGHGHSCGASLISPNWLVSAAHCYIDTRGSRWSDPTQWTAFLGLHDQSQRSAPGVQERRLKRIISHPFFNDDVPLDYDIALLELEKPAEYSSMVRPISLPDASHVFPAGKAIWVTGWGHTQYGGTHALILQKGEIRVINQTTCENLLPQLITPRMMCVGFLSGGVDSCEGDSGGPLSSVEADGRIFQAGVVSWGDGCAQRNKPGVYTRLPLFRDWIKENTGV

SEQ ID NO: 25 - protein, 242 aa, Artificial Sequence
  MEMBRANE TYPE SERINE PROTEASE 1 (MT-SP1) protease domain Q38H/I41S/D60bT/F60eS/Y60gW/F97D/ins97aV/T98P/F99L /C122S/G151H/Q175L/Q192D
VVGGTDADEGEWPWQVSLHALGHGHSCGASLISPNWLVSAAHCYIDTRGSRWSDPTQWTAFLGLHDQSQRSAPGVQERRLKRIISHPFFNDDVPLDYDIALLELEKPAEYSSMVRPISLPDASHVFPAGKAIWVTGWGHTQYGGTHALILQKGEIRVINQTTCENLLPQLITPRMMCVGFLSGGVDSCDGDSGGPLSSVEADGRIFQAGVVSWGDGCAQRNKPGVYTRLPLFRDWIKENTGV

SEQ ID NO: 26 - protein, 242 aa, Artificial Sequence
  MEMBRANE TYPE SERINE PROTEASE 1 (MT-SP1) protease domain Q38H/I41A/D60bT/F60eK/Y60gW/F97T/ins97aE/T98G/F99L /C122S/G151H/Q175L/Q192D
VVGGTDADEGEWPWQVSLHALGHGHACGASLISPNWLVSAAHCYIDTRGKRWSDPTQWTAFLGLHDQSQRSAPGVQERRLKRIISHPFFNDTEGLDYDIALLELEKPAEYSSMVRPISLPDASHVFPAGKAIWVTGWGHTQYGGTHALILQKGEIRVINQTTCENLLPQLITPRMMCVGFLSGGVDSCDGDSGGPLSSVEADGRIFQAGVVSWGDGCAQRNKPGVYTRLPLFRDWIKENTGV

SEQ ID NO: 27 - protein, 242 aa, Artificial Sequence
  MEMBRANE TYPE SERINE PROTEASE 1 (MT-SP1) protease domain Q38H/I41S/D60bT/F60eS/Y60gW/F97D/ins97aV/T98P/F99L /C122S/G151N/Q175L/Q192D
VVGGTDADEGEWPWQVSLHALGHGHSCGASLISPNWLVSAAHCYIDTRGSRWSDPTQWTAFLGLHDQSQRSAPGVQERRLKRIISHPFFNDDVPLDYDIALLELEKPAEYSSMVRPISLPDASHVFPAGKAIWVTGWGHTQYGGTNALILQKGEIRVINQTTCENLLPQLITPRMMCVGFLSGGVDSCDGDSGGPLSSVEADGRIFQAGVVSWGDGCAQRNKPGVYTRLPLFRDWIKENTGV

SEQ ID NO: 28 - protein, 242 aa, Artificial Sequence
  MEMBRANE TYPE SERINE PROTEASE 1 (MT-SP1) protease domain Q38H/I41A/D60bV/F60eR/Y60gW/F97T/ins97aE/T98G/F99L /C122S/G151H/Q175L/Q192D
VVGGTDADEGEWPWQVSLHALGHGHACGASLISPNWLVSAAHCYIDVRGRRWSDPTQWTAFLGLHDQSQRSAPGVQERRLKRIISHPFFNDTEGLDYDIALLELEKPAEYSSMVRPISLPDASHVFPAGKAIWVTGWGHTQYGGTHALILQKGEIRVINQTTCENLLPQLITPRMMCVGFLSGGVDSCDGDSGGPLSSVEADGRIFQAGVVSWGDGCAQRNKPGVYTRLPLFRDWIKENTGV

SEQ ID NO: 29 - protein, 242 aa, Artificial Sequence
  MEMBRANE TYPE SERINE PROTEASE 1 (MT-SP1) protease domain Q38H/I41A/D60bV/F60eR/Y60gW/D96I/F97Y/ins97aN/T98G /F99L/C122S/G151N/Q175L/Q192D
VVGGTDADEGEWPWQVSLHALGHGHACGASLISPNWLVSAAHCYIDVRGRRWSDPTQWTAFLGLHDQSQRSAPGVQERRLKRIISHPFFNIYNGLDYDIALLELEKPAEYSSMVRPISLPDASHVFPAGKAIWVTGWGHTQYGGTNALILQKGEIRVINQTTCENLLPQLITPRMMCVGFLSGGVDSCDGDSGGPLSSVEADGRIFQAGVVSWGDGCAQRNKPGVYTRLPLFRDWIKENTGV

SEQ ID NO: 30 - protein, 242 aa, Artificial Sequence
  MEMBRANE TYPE SERINE PROTEASE 1 (MT-SP1) protease domain Q38H/I41S/D60bT/F60eS/Y60gW/D96K/F97D/ins97aA/T98P /F99L/C122S/G151H/Q175L/Q192D
VVGGTDADEGEWPWQVSLHALGHGHSCGASLISPNWLVSAAHCYIDTRGSRWSDPTQWTAFLGLHDQSQRSAPGVQERRLKRIISHPFFNKDAPLDYDIALLELEKPAEYSSMVRPISLPDASHVFPAGKAIWVTGWGHTQYGGTHALILQKGEIRVINQTTCENLLPQLITPRMMCVGFLSGGVDSCDGDSGGPLSSVEADGRIFQAGVVSWGDGCAQRNKPGVYTRLPLFRDWIKENTGV

SEQ ID NO: 31 - protein, 242 aa, Artificial Sequence
  MEMBRANE TYPE SERINE PROTEASE 1 (MT-SP1) protease domain Q38H/I41A/D60bV/F60eR/Y60gW/D96P/F97W/ins97aN/T98G /F99L/C122S/G151N/Q175L/Q192E
VVGGTDADEGEWPWQVSLHALGHGHACGASLISPNWLVSAAHCYIDVRGRRWSDPTQWTAFLGLHDQSQRSAPGVQERRLKRIISHPFFNPWNGLDYDIALLELEKPAEYSSMVRPISLPDASHVFPAGKAIWVTGWGHTQYGGTNALILQKGEIRVINQTTCENLLPQLITPRMMCVGFLSGGVDSCEGDSGGPLSSVEADGRIFQAGVVSWGDGCAQRNKPGVYTRLPLFRDWIKENTGV

SEQ ID NO: 32 - protein, 241 aa, Artificial Sequence
  MEMBRANE TYPE SERINE PROTEASE 1 (MT-SP1) protease domain Q38H/I41A/D60bV/F60eR/Y60gW/D96I/F97N/T98G/F99L/C1 22S/G151N/Q175L/Q192D
VVGGTDADEGEWPWQVSLHALGHGHACGASLISPNWLVSAAHCYIDVRGRRWSDPTQWTAFLGLHDQSQRSAPGVQERRLKRIISHPFFNINGLDYDIALLELEKPAEYSSMVRPISLPDASHVFPAGKAIWVTGWGHTQYGGTNALILQKGEIRVINQTTCENLLPQLITPRMMCVGFLSGGVDSCDGDSGGPLSSVEADGRIFQAGVVSWGDGCAQRNKPGVYTRLPLFRDWIKENTGV

SEQ ID NO: 33 - protein, 242 aa, Artificial Sequence
  MEMBRANE TYPE SERINE PROTEASE 1 (MT-SP1) protease domain Q38H/I41S/D60bT/F60eS/Y60gW/D96Y/F97E/ins97aV/T98G /F99L/C122S/G151H/Q175L/Q192D
VVGGTDADEGEWPWQVSLHALGHGHSCGASLISPNWLVSAAHCYIDTRGSRWSDPTQWTAFLGLHDQSQRSAPGVQERRLKRIISHPFFNYEVGLDYDIALLELEKPAEYSSMVRPISLPDASHVFPAGKAIWVTGWGHTQYGGTHALILQKGEIRVINQTTCENLLPQLITPRMMCVGFLSGGVDSCDGDSGGPLSSVEADGRIFQAGVVSWGDGCAQRNKPGVYTRLPLFRDWIKENTGV

SEQ ID NO: 34 - protein, 242 aa, Artificial Sequence
  MEMBRANE TYPE SERINE PROTEASE 1 (MT-SP1) protease domain Q38H/I41S/D60bT/F60eS/Y60gW/D96L/F97D/ins97aG/T98N /F99L/C122S/G151H/Q175L/Q192E
VVGGTDADEGEWPWQVSLHALGHGHSCGASLISPNWLVSAAHCYIDTRGSRWSDPTQWTAFLGLHDQSQRSAPGVQERRLKRIISHPFFNLDGNLDYDIALLELEKPAEYSSMVRPISLPDASHVFPAGKAIWVTGWGHTQYGGTHALILQKGEIRVINQTTCENLLPQLITPRMMCVGFLSGGVDSCEGDSGGPLSSVEADGRIFQAGVVSWGDGCAQRNKPGVYTRLPLFRDWIKENTGV

SEQ ID NO: 35 - protein, 242 aa, Artificial Sequence
  MEMBRANE TYPE SERINE PROTEASE 1 (MT-SP1) protease domain Q38H/I41S/D60bT/F60eS/Y60gW/D96K/F97G/ins97aV/T98P /F99L/C122S/G151H/Q175L/Q192D
VVGGTDADEGEWPWQVSLHALGHGHSCGASLISPNWLVSAAHCYIDTRGSRWSDPTQWTAFLGLHDQSQRSAPGVQERRLKRIISHPFFNKGVPLDYDIALLELEKPAEYSSMVRPISLPDASHVFPAGKAIWVTGWGHTQYGGTHALILQKGEIRVINQTTCENLLPQLITPRMMCVGFLSGGVDSCDGDSGGPLSSVEADGRIFQAGVVSWGDGCAQRNKPGVYTRLPLFRDWIKENTGV

SEQ ID NO: 36 - protein, 242 aa, Artificial Sequence
  MEMBRANE TYPE SERINE PROTEASE 1 (MT-SP1) protease domain Q38H/I41S/D60bT/F60eS/Y60gW/D96V/F97G/ins97aV/T98P /F99L/C122S/G151H/Q175L/Q192D
VVGGTDADEGEWPWQVSLHALGHGHSCGASLISPNWLVSAAHCYIDTRGSRWSDPTQWTAFLGLHDQSQRSAPGVQERRLKRIISHPFFNVGVPLDYDIALLELEKPAEYSSMVRPISLPDASHVFPAGKAIWVTGWGHTQYGGTHALILQKGEIRVINQTTCENLLPQLITPRMMCVGFLSGGVDSCDGDSGGPLSSVEADGRIFQAGVVSWGDGCAQRNKPGVYTRLPLFRDWIKENTGV

SEQ ID NO: 37 - protein, 242 aa, Artificial Sequence
  MEMBRANE TYPE SERINE PROTEASE 1 (MT-SP1) protease domain Q38H/I41S/D60bT/F60eS/Y60gW/D96K/F97D/ins97aA/T98P /F99L/C122S/G151N/Q175L/Q192D
VVGGTDADEGEWPWQVSLHALGHGHSCGASLISPNWLVSAAHCYIDTRGSRWSDPTQWTAFLGLHDQSQRSAPGVQERRLKRIISHPFFNKDAPLDYDIALLELEKPAEYSSMVRPISLPDASHVFPAGKAIWVTGWGHTQYGGTNALILQKGEIRVINQTTCENLLPQLITPRMMCVGFLSGGVDSCDGDSGGPLSSVEADGRIFQAGVVSWGDGCAQRNKPGVYTRLPLFRDWIKENTGV

SEQ ID NO: 38 - protein, 242 aa, Artificial Sequence
  MEMBRANE TYPE SERINE PROTEASE 1 (MT-SP1) protease domain Q38H/I41S/D60bT/F60eS/Y60gW/F97G/ins97aV/T98P/F99L /C122S/G151H/Q175L/Q192D
VVGGTDADEGEWPWQVSLHALGHGHSCGASLISPNWLVSAAHCYIDTRGSRWSDPTQWTAFLGLHDQSQRSAPGVQERRLKRIISHPFFNDGVPLDYDIALLELEKPAEYSSMVRPISLPDASHVFPAGKAIWVTGWGHTQYGGTHALILQKGEIRVINQTTCENLLPQLITPRMMCVGFLSGGVDSCDGDSGGPLSSVEADGRIFQAGVVSWGDGCAQRNKPGVYTRLPLFRDWIKENTGV

SEQ ID NO: 39 - protein, 242 aa, Artificial Sequence
  MEMBRANE TYPE SERINE PROTEASE 1 (MT-SP1) protease domain Q38H/I41S/D60bT/F60eS/Y60gW/D96K/ins97aV/T98P/F99L /C122S/G151H/Q175L/Q192D
VVGGTDADEGEWPWQVSLHALGHGHSCGASLISPNWLVSAAHCYIDTRGSRWSDPTQWTAFLGLHDQSQRSAPGVQERRLKRIISHPFFNKFVPLDYDIALLELEKPAEYSSMVRPISLPDASHVFPAGKAIWVTGWGHTQYGGTHALILQKGEIRVINQTTCENLLPQLITPRMMCVGFLSGGVDSCDGDSGGPLSSVEADGRIFQAGVVSWGDGCAQRNKPGVYTRLPLFRDWIKENTGV

SEQ ID NO: 40 - protein, 242 aa, Artificial Sequence
  MEMBRANE TYPE SERINE PROTEASE 1 (MT-SP1) protease domain Q38H/I41S/D60bT/F60eS/Y60gW/D96K/F97G/ins97aV/T98P /F99L/C122S/G151H/Q175L
VVGGTDADEGEWPWQVSLHALGHGHSCGASLISPNWLVSAAHCYIDTRGSRWSDPTQWTAFLGLHDQSQRSAPGVQERRLKRIISHPFFNKGVPLDYDIALLELEKPAEYSSMVRPISLPDASHVFPAGKAIWVTGWGHTQYGGTHALILQKGEIRVINQTTCENLLPQLITPRMMCVGFLSGGVDSCQGDSGGPLSSVEADGRIFQAGVVSWGDGCAQRNKPGVYTRLPLFRDWIKENTGV

SEQ ID NO: 41 - protein, 241 aa, Artificial Sequence
  MEMBRANE TYPE SERINE PROTEASE 1 (MT-SP1) protease domain    I41E/F99L/C122S/G151N/Q192T
VVGGTDADEGEWPWQVSLHALGQGHECGASLISPNWLVSAAHCYIDDRGFRYSDPTQWTAFLGLHDQSQRSAPGVQERRLKRIISHPFFNDFTLDYDIALLELEKPAEYSSMVRPISLPDASHVFPAGKAIWVTGWGHTQYGGTNALILQKGEIRVINQTTCENLLPQQITPRMMCVGFLSGGVDSCTGDSGGPLSSVEADGRIFQAGVVSWGDGCAQRNKPGVYTRLPLFRDWIKENTGV

SEQ ID NO: 42 - protein, 241 aa, Artificial Sequence
  MEMBRANE TYPE SERINE PROTEASE 1 (MT-SP1) protease domain     I41D/C122S/G151N/Q192T
VVGGTDADEGEWPWQVSLHALGQGHDCGASLISPNWLVSAAHCYIDDRGFRYSDPTQWTAFLGLHDQSQRSAPGVQERRLKRIISHPFFNDFTFDYDIALLELEKPAEYSSMVRPISLPDASHVFPAGKAIWVTGWGHTQYGGTNALILQKGEIRVINQTTCENLLPQQITPRMMCVGFLSGGVDSCTGDSGGPLSSVEADGRIFQAGVVSWGDGCAQRNKPGVYTRLPLFRDWIKENTGV

SEQ ID NO: 43 - protein, 241 aa, Artificial Sequence
  MEMBRANE TYPE SERINE PROTEASE 1 (MT-SP1) protease domain      I41S/F99L/C122S/G151N/Q192V
VVGGTDADEGEWPWQVSLHALGQGHSCGASLISPNWLVSAAHCYIDDRGFRYSDPTQWTAFLGLHDQSQRSAPGVQERRLKRIISHPFFNDFTLDYDIALLELEKPAEYSSMVRPISLPDASHVFPAGKAIWVTGWGHTQYGGTNALILQKGEIRVINQTTCENLLPQQITPRMMCVGFLSGGVDSCVGDSGGPLSSVEADGRIFQAGVVSWGDGCAQRNKPGVYTRLPLFRDWIKENTGV

SEQ ID NO: 44 - protein, 241 aa, Artificial Sequence; identical to SEQ ID NO: 41
  MEMBRANE TYPE SERINE PROTEASE 1 (MT-SP1) protease domain       I41E/F99L/C122S/G151N/Q192T

SEQ ID NO: 45 - protein, 241 aa, Artificial Sequence
  MEMBRANE TYPE SERINE PROTEASE 1 (MT-SP1) protease domain      I41D/Y59F/D96E/F99L/C122S/G151N/Q192T
VVGGTDADEGEWPWQVSLHALGQGHDCGASLISPNWLVSAAHCFIDDRGFRYSDPTQWTAFLGLHDQSQRSAPGVQERRLKRIISHPFFNEFTLDYDIALLELEKPAEYSSMVRPISLPDASHVFPAGKAIWVTGWGHTQYGGTNALILQKGEIRVINQTTCENLLPQQITPRMMCVGFLSGGVDSCTGDSGGPLSSVEADGRIFQAGVVSWGDGCAQRNKPGVYTRLPLFRDWIKENTGV

SEQ ID NO: 46 - protein, 241 aa, Artificial Sequence
  MEMBRANE TYPE SERINE PROTEASE 1 (MT-SP1) protease domain     I41D/Y59F/C122S/G151N/Q192T
VVGGTDADEGEWPWQVSLHALGQGHDCGASLISPNWLVSAAHCFIDDRGFRYSDPTQWTAFLGLHDQSQRSAPGVQERRLKRIISHPFFNDFTFDYDIALLELEKPAEYSSMVRPISLPDASHVFPAGKAIWVTGWGHTQYGGTNALILQKGEIRVINQTTCENLLPQQITPRMMCVGFLSGGVDSCTGDSGGPLSSVEADGRIFQAGVVSWGDGCAQRNKPGVYTRLPLFRDWIKENTGV

SEQ ID NO: 47 - protein, 242 aa, Artificial Sequence
  MEMBRANE TYPE SERINE PROTEASE 1 (MT-SP1) protease domain I41S/D60bT/F60eS/Y60gW/D96K/F97G/ins97aV/T98P/F99L /C122S/G151H/Q175L/Q192D
VVGGTDADEGEWPWQVSLHALGQGHSCGASLISPNWLVSAAHCYIDTRGSRWSDPTQWTAFLGLHDQSQRSAPGVQERRLKRIISHPFFNKGVPLDYDIALLELEKPAEYSSMVRPISLPDASHVFPAGKAIWVTGWGHTQYGGTHALILQKGEIRVINQTTCENLLPQLITPRMMCVGFLSGGVDSCDGDSGGPLSSVEADGRIFQAGVVSWGDGCAQRNKPGVYTRLPLFRDWIKENTGV

SEQ ID NO: 48 - protein, 242 aa, Artificial Sequence
  MEMBRANE TYPE SERINE PROTEASE 1 (MT-SP1) protease domain Q38H/D60bT/F60eS/Y60gW/D96K/F97G/ins97aV/T98P/F99L /C122S/G151H/Q175L/Q192D
VVGGTDADEGEWPWQVSLHALGHGHICGASLISPNWLVSAAHCYIDTRGSRWSDPTQWTAFLGLHDQSQRSAPGVQERRLKRIISHPFFNKGVPLDYDIALLELEKPAEYSSMVRPISLPDASHVFPAGKAIWVTGWGHTQYGGTHALILQKGEIRVINQTTCENLLPQLITPRMMCVGFLSGGVDSCDGDSGGPLSSVEADGRIFQAGVVSWGDGCAQRNKPGVYTRLPLFRDWIKENTGV

SEQ ID NO: 49 - protein, 242 aa, Artificial Sequence
  MEMBRANE TYPE SERINE PROTEASE 1 (MT-SP1) protease domain Q38H/I41S/F60eS/Y60gW/D96K/F97G/ins97aV/T98P/F99L/ C122S/G151H/Q175L/Q192D
VVGGTDADEGEWPWQVSLHALGHGHSCGASLISPNWLVSAAHCYIDDRGSRWSDPTQWTAFLGLHDQSQRSAPGVQERRLKRIISHPFFNKGVPLDYDIALLELEKPAEYSSMVRPISLPDASHVFPAGKAIWVTGWGHTQYGGTHALILQKGEIRVINQTTCENLLPQLITPRMMCVGFLSGGVDSCDGDSGGPLSSVEADGRIFQAGVVSWGDGCAQRNKPGVYTRLPLFRDWIKENTGV

SEQ ID NO: 50 - protein, 242 aa, Artificial Sequence
  MEMBRANE TYPE SERINE PROTEASE 1 (MT-SP1) protease domain Q38H/I41S/D60bT/Y60gW/D96K/F97G/ins97aV/T98P/F99L/ C122S/G151H/Q175L/Q192D
VVGGTDADEGEWPWQVSLHALGHGHSCGASLISPNWLVSAAHCYIDTRGFRWSDPTQWTAFLGLHDQSQRSAPGVQERRLKRIISHPFFNKGVPLDYDIALLELEKPAEYSSMVRPISLPDASHVFPAGKAIWVTGWGHTQYGGTHALILQKGEIRVINQTTCENLLPQLITPRMMCVGFLSGGVDSCDGDSGGPLSSVEADGRIFQAGVVSWGDGCAQRNKPGVYTRLPLFRDWIKENTGV

SEQ ID NO: 51 - protein, 242 aa, Artificial Sequence
  MEMBRANE TYPE SERINE PROTEASE 1 (MT-SP1) protease domain Q38H/I41S/D60bT/F60eS/D96K/F97G/ins97aV/T98P/F99L/ C122S/G151H/Q175L/Q192D
VVGGTDADEGEWPWQVSLHALGHGHSCGASLISPNWLVSAAHCYIDTRGSRYSDPTQWTAFLGLHDQSQRSAPGVQERRLKRIISHPFFNKGVPLDYDIALLELEKPAEYSSMVRPISLPDASHVFPAGKAIWVTGWGHTQYGGTHALILQKGEIRVINQTTCENLLPQLITPRMMCVGFLSGGVDSCDGDSGGPLSSVEADGRIFQAGVVSWGDGCAQRNKPGVYTRLPLFRDWIKENTGV

SEQ ID NO: 52 - protein, 241 aa, Artificial Sequence
  MEMBRANE TYPE SERINE PROTEASE 1 (MT-SP1) protease domain Q38H/I41S/D60bT/F60eS/Y60gW/D96K/F97G/T98P/F99L/C1 22S/G151H/Q175L/Q192D
VVGGTDADEGEWPWQVSLHALGHGHSCGASLISPNWLVSAAHCYIDTRGSRWSDPTQWTAFLGLHDQSQRSAPGVQERRLKRIISHPFFNKGPLDYDIALLELEKPAEYSSMVRPISLPDASHVFPAGKAIWVTGWGHTQYGGTHALILQKGEIRVINQTTCENLLPQLITPRMMCVGFLSGGVDSCDGDSGGPLSSVEADGRIFQAGVVSWGDGCAQRNKPGVYTRLPLFRDWIKENTGV

SEQ ID NO: 53 - protein, 242 aa, Artificial Sequence
  MEMBRANE TYPE SERINE PROTEASE 1 (MT-SP1) protease domain Q38H/I41S/D60bT/F60eS/Y60gW/D96K/F97G/ins97aV/F99L /C122S/G151H/Q175L/Q192D
VVGGTDADEGEWPWQVSLHALGHGHSCGASLISPNWLVSAAHCYIDTRGSRWSDPTQWTAFLGLHDQSQRSAPGVQERRLKRIISHPFFNKGVTLDYDIALLELEKPAEYSSMVRPISLPDASHVFPAGKAIWVTGWGHTQYGGTHALILQKGEIRVINQTTCENLLPQLITPRMMCVGFLSGGVDSCDGDSGGPLSSVEADGRIFQAGVVSWGDGCAQRNKPGVYTRLPLFRDWIKENTGV

SEQ ID NO: 54 - protein, 242 aa, Artificial Sequence
  MEMBRANE TYPE SERINE PROTEASE 1 (MT-SP1) protease domain Q38H/I41S/D60bT/F60eS/Y60gW/D96K/F97G/ins97aV/T98P /C122S/G151H/Q175L/Q192D
VVGGTDADEGEWPWQVSLHALGHGHSCGASLISPNWLVSAAHCYIDTRGSRWSDPTQWTAFLGLHDQSQRSAPGVQERRLKRIISHPFFNKGVPFDYDIALLELEKPAEYSSMVRPISLPDASHVFPAGKAIWVTGWGHTQYGGTHALILQKGEIRVINQTTCENLLPQLITPRMMCVGFLSGGVDSCDGDSGGPLSSVEADGRIFQAGVVSWGDGCAQRNKPGVYTRLPLFRDWIKENTGV

SEQ ID NO: 55 - protein, 242 aa, Artificial Sequence
  MEMBRANE TYPE SERINE PROTEASE 1 (MT-SP1) protease domain Q38H/I41S/D60bT/F60eS/Y60gW/D96K/F97G/ins97aV/T98P /F99L/C122S/Q175L/Q192D
VVGGTDADEGEWPWQVSLHALGHGHSCGASLISPNWLVSAAHCYIDTRGSRWSDPTQWTAFLGLHDQSQRSAPGVQERRLKRIISHPFFNKGVPLDYDIALLELEKPAEYSSMVRPISLPDASHVFPAGKAIWVTGWGHTQYGGTGALILQKGEIRVINQTTCENLLPQLITPRMMCVGFLSGGVDSCDGDSGGPLSSVEADGRIFQAGVVSWGDGCAQRNKPGVYTRLPLFRDWIKENTGV

SEQ ID NO: 56 - protein, 242 aa, Artificial Sequence
  MEMBRANE TYPE SERINE PROTEASE 1 (MT-SP1) protease domain Q38H/I41S/D60bT/F60eS/Y60gW/D96K/F97G/ins97aV/T98P /F99L/C122S/G151H/Q192D
VVGGTDADEGEWPWQVSLHALGHGHSCGASLISPNWLVSAAHCYIDTRGSRWSDPTQWTAFLGLHDQSQRSAPGVQERRLKRIISHPFFNKGVPLDYDIALLELEKPAEYSSMVRPISLPDASHVFPAGKAIWVTGWGHTQYGGTHALILQKGEIRVINQTTCENLLPQQITPRMMCVGFLSGGVDSCDGDSGGPLSSVEADGRIFQAGVVSWGDGCAQRNKPGVYTRLPLFRDWIKENTGV

SEQ ID NO: 57 - protein, 242 aa, Artificial Sequence
  MEMBRANE TYPE SERINE PROTEASE 1 (MT-SP1) protease domain Q38H/I41S/D96K/F97G/ins97aV/T98P/F99L/C122S/Q192D
VVGGTDADEGEWPWQVSLHALGHGHSCGASLISPNWLVSAAHCYIDDRGFRYSDPTQWTAFLGLHDQSQRSAPGVQERRLKRIISHPFFNKGVPLDYDIALLELEKPAEYSSMVRPISLPDASHVFPAGKAIWVTGWGHTQYGGTGALILQKGEIRVINQTTCENLLPQQITPRMMCVGFLSGGVDSCDGDSGGPLSSVEADGRIFQAGVVSWGDGCAQRNKPGVYTRLPLFRDWIKENTGV

SEQ ID NO: 58 - protein, 242 aa, Artificial Sequence
  MEMBRANE TYPE SERINE PROTEASE 1 (MT-SP1) protease domain I41S/D96K/F97G/ins97aV/T98P/F99L/C122S/Q175L/Q192D
VVGGTDADEGEWPWQVSLHALGQGHSCGASLISPNWLVSAAHCYIDDRGFRYSDPTQWTAFLGLHDQSQRSAPGVQERRLKRIISHPFFNKGVPLDYDIALLELEKPAEYSSMVRPISLPDASHVFPAGKAIWVTGWGHTQYGGTGALILQKGEIRVINQTTCENLLPQLITPRMMCVGFLSGGVDSCDGDSGGPLSSVEADGRIFQAGVVSWGDGCAQRNKPGVYTRLPLFRDWIKENTGV

SEQ ID NO: 59 - protein, 242 aa, Artificial Sequence
  MEMBRANE TYPE SERINE PROTEASE 1 (MT-SP1) protease domain Q38H/I41S/D96K/F97G/ins97aV/T98P/F99L/C122S/Q175L/ Q192D
VVGGTDADEGEWPWQVSLHALGHGHSCGASLISPNWLVSAAHCYIDDRGFRYSDPTQWTAFLGLHDQSQRSAPGVQERRLKRIISHPFFNKGVPLDYDIALLELEKPAEYSSMVRPISLPDASHVFPAGKAIWVTGWGHTQYGGTGALILQKGEIRVINQTTCENLLPQLITPRMMCVGFLSGGVDSCDGDSGGPLSSVEADGRIFQAGVVSWGDGCAQRNKPGVYTRLPLFRDWIKENTGV

SEQ ID NO: 60 - protein, 855 aa, Artificial Sequence [sequence omitted]

SEQ ID NO: 61 - protein, 330 aa, Artificial Sequence [sequence omitted]

SEQ ID NO: 62 - protein, 231 aa, Artificial Sequence
  hIgG1 Fc
PKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 63 - protein, 242 aa, Artificial Sequence
  MEMBRANE TYPE SERINE PROTEASE 1 (MT-SP1) protease domain I41S/D96K/F97G/ins97aV/T98P/F99L/C122S/Q192D
VVGGTDADEGEWPWQVSLHALGQGHSCGASLISPNWLVSAAHCYIDDRGFRYSDPTQWTAFLGLHDQSQRSAPGVQERRLKRIISHPFFNKGVPLDYDIALLELEKPAEYSSMVRPISLPDASHVFPAGKAIWVTGWGHTQYGGTGALILQKGEIRVINQTTCENLLPQQITPRMMCVGFLSGGVDSCDGDSGGPLSSVEADGRIFQAGVVSWGDGCAQRNKPGVYTRLPLFRDWIKENTGV

SEQ ID NO: 64 - protein, 242 aa, Artificial Sequence; identical to SEQ ID NO: 59
  MEMBRANE TYPE SERINE PROTEASE 1 (MT-SP1) protease domain Q38H/I41S/D96K/F97G/ins97aV/T98P/F99L/C122S/Q175L/ Q192D

SEQ ID NO: 65 - protein, 242 aa, Artificial Sequence
  MEMBRANE TYPE SERINE PROTEASE 1 (MT-SP1) protease domain Q38H/I41S/D60bY/D96K/F97G/ins97aV/T98P/F99L/C122S/ Q192D/D217V
VVGGTDADEGEWPWQVSLHALGHGHSCGASLISPNWLVSAAHCYIDYRGFRYSDPTQWTAFLGLHDQSQRSAPGVQERRLKRIISHPFFNKGVPLDYDIALLELEKPAEYSSMVRPISLPDASHVFPAGKAIWVTGWGHTQYGGTGALILQKGEIRVINQTTCENLLPQQITPRMMCVGFLSGGVDSCDGDSGGPLSSVEADGRIFQAGVVSWGVGCAQRNKPGVYTRLPLFRDWIKENTGV

SEQ ID NO: 66 - protein, 242 aa, Artificial Sequence
  MEMBRANE TYPE SERINE PROTEASE 1 (MT-SP1) protease domain I41S/D96K/F97G/ins97aV/T98P/F99L/C122S/Q192G/D217V
VVGGTDADEGEWPWQVSLHALGQGHSCGASLISPNWLVSAAHCYIDDRGFRYSDPTQWTAFLGLHDQSQRSAPGVQERRLKRIISHPFFNKGVPLDYDIALLELEKPAEYSSMVRPISLPDASHVFPAGKAIWVTGWGHTQYGGTGALILQKGEIRVINQTTCENLLPQQITPRMMCVGFLSGGVDSCGGDSGGPLSSVEADGRIFQAGVVSWGVGCAQRNKPGVYTRLPLFRDWIKENTGV

SEQ ID NO: 67 - protein, 242 aa, Artificial Sequence
  MEMBRANE TYPE SERINE PROTEASE 1 (MT-SP1) protease domain I41S/D60bY/D96K/F97G/ins97aV/T98P/F99L/C122S/Q192D /D217V
VVGGTDADEGEWPWQVSLHALGQGHSCGASLISPNWLVSAAHCYIDYRGFRYSDPTQWTAFLGLHDQSQRSAPGVQERRLKRIISHPFFNKGVPLDYDIALLELEKPAEYSSMVRPISLPDASHVFPAGKAIWVTGWGHTQYGGTGALILQKGEIRVINQTTCENLLPQQITPRMMCVGFLSGGVDSCDGDSGGPLSSVEADGRIFQAGVVSWGVGCAQRNKPGVYTRLPLFRDWIKENTGV

SEQ ID NO: 68 - protein, 242 aa, Artificial Sequence
  MEMBRANE TYPE SERINE PROTEASE 1 (MT-SP1) protease domain I41S/D96M/F97G/ins97aV/T98P/F99L/C122S/Q192G/D217V
VVGGTDADEGEWPWQVSLHALGQGHSCGASLISPNWLVSAAHCYIDDRGFRYSDPTQWTAFLGLHDQSQRSAPGVQERRLKRIISHPFFNMGVPLDYDIALLELEKPAEYSSMVRPISLPDASHVFPAGKAIWVTGWGHTQYGGTGALILQKGEIRVINQTTCENLLPQQITPRMMCVGFLSGGVDSCGGDSGGPLSSVEADGRIFQAGVVSWGVGCAQRNKPGVYTRLPLFRDWIKENTGV

SEQ ID NO: 69 - protein, 242 aa, Artificial Sequence
  MEMBRANE TYPE SERINE PROTEASE 1 (MT-SP1) protease domain I41S/D96K/F97G/ins97aV/T98P/F99L/C122S/Q192V/D217I
VVGGTDADEGEWPWQVSLHALGQGHSCGASLISPNWLVSAAHCYIDDRGFRYSDPTQWTAFLGLHDQSQRSAPGVQERRLKRIISHPFFNKGVPLDYDIALLELEKPAEYSSMVRPISLPDASHVFPAGKAIWVTGWGHTQYGGTGALILQKGEIRVINQTTCENLLPQQITPRMMCVGFLSGGVDSCVGDSGGPLSSVEADGRIFQAGVVSWGIGCAQRNKPGVYTRLPLFRDWIKENTGV

SEQ ID NO: 70 - protein, 242 aa, Artificial Sequence
  MEMBRANE TYPE SERINE PROTEASE 1 (MT-SP1) protease domain I41S/D96K/F97G/ins97aV/T98P/F99L/C122S/Q192H
VVGGTDADEGEWPWQVSLHALGQGHSCGASLISPNWLVSAAHCYIDDRGFRYSDPTQWTAFLGLHDQSQRSAPGVQERRLKRIISHPFFNKGVPLDYDIALLELEKPAEYSSMVRPISLPDASHVFPAGKAIWVTGWGHTQYGGTGALILQKGEIRVINQTTCENLLPQQITPRMMCVGFLSGGVDSCHGDSGGPLSSVEADGRIFQAGVVSWGDGCAQRNKPGVYTRLPLFRDWIKENTGV

SEQ ID NO: 71 - protein, 242 aa, Artificial Sequence
  MEMBRANE TYPE SERINE PROTEASE 1 (MT-SP1) protease domain I41S/D96K/F97G/ins97aV/T98P/F99L/C122S/Q192N/D217V
VVGGTDADEGEWPWQVSLHALGQGHSCGASLISPNWLVSAAHCYIDDRGFRYSDPTQWTAFLGLHDQSQRSAPGVQERRLKRIISHPFFNKGVPLDYDIALLELEKPAEYSSMVRPISLPDASHVFPAGKAIWVTGWGHTQYGGTGALILQKGEIRVINQTTCENLLPQQITPRMMCVGFLSGGVDSCNGDSGGPLSSVEADGRIFQAGVVSWGVGCAQRNKPGVYTRLPLFRDWIKENTGV

SEQ ID NO: 72 - protein, 242 aa, Artificial Sequence
  MEMBRANE TYPE SERINE PROTEASE 1 (MT-SP1) protease domain I41S/D60bY/D96K/F97G/ins97aV/T98P/F99L/C122S/Q175L /Q192D
VVGGTDADEGEWPWQVSLHALGQGHSCGASLISPNWLVSAAHCYIDYRGFRYSDPTQWTAFLGLHDQSQRSAPGVQERRLKRIISHPFFNKGVPLDYDIALLELEKPAEYSSMVRPISLPDASHVFPAGKAIWVTGWGHTQYGGTGALILQKGEIRVINQTTCENLLPQLITPRMMCVGFLSGGVDSCDGDSGGPLSSVEADGRIFQAGVVSWGDGCAQRNKPGVYTRLPLFRDWIKENTGV

SEQ ID NO: 73 - protein, 242 aa, Artificial Sequence
  MEMBRANE TYPE SERINE PROTEASE 1 (MT-SP1) protease domain Q38H/I41S/D96K/F97G/ins97aV/T98P/F99L/C122S/Q192G/ D217V
VVGGTDADEGEWPWQVSLHALGHGHSCGASLISPNWLVSAAHCYIDDRGFRYSDPTQWTAFLGLHDQSQRSAPGVQERRLKRIISHPFFNKGVPLDYDIALLELEKPAEYSSMVRPISLPDASHVFPAGKAIWVTGWGHTQYGGTGALILQKGEIRVINQTTCENLLPQQITPRMMCVGFLSGGVDSCGGDSGGPLSSVEADGRIFQAGVVSWGVGCAQRNKPGVYTRLPLFRDWIKENTGV

SEQ ID NO: 74 - protein, 242 aa, Artificial Sequence
  MEMBRANE TYPE SERINE PROTEASE 1 (MT-SP1) protease domain I41S/D96K/F97G/ins97aV/T98P/F99L/C122S/Q175L/Q192V
VVGGTDADEGEWPWQVSLHALGQGHSCGASLISPNWLVSAAHCYIDDRGFRYSDPTQWTAFLGLHDQSQRSAPGVQERRLKRIISHPFFNKGVPLDYDIALLELEKPAEYSSMVRPISLPDASHVFPAGKAIWVTGWGHTQYGGTGALILQKGEIRVINQTTCENLLPQLITPRMMCVGFLSGGVDSCVGDSGGPLSSVEADGRIFQAGVVSWGDGCAQRNKPGVYTRLPLFRDWIKENTGV

SEQ ID NO: 75 - protein, 242 aa, Artificial Sequence
  MEMBRANE TYPE SERINE PROTEASE 1 (MT-SP1) protease domain I41S/P49S/D96K/F97G/ins97aV/T98P/F99L/C122S/Q192G/ D217V
VVGGTDADEGEWPWQVSLHALGQGHSCGASLISSNWLVSAAHCYIDDRGFRYSDPTQWTAFLGLHDQSQRSAPGVQERRLKRIISHPFFNKGVPLDYDIALLELEKPAEYSSMVRPISLPDASHVFPAGKAIWVTGWGHTQYGGTGALILQKGEIRVINQTTCENLLPQQITPRMMCVGFLSGGVDSCSGDSGGPLSSVEADGRIFQAGVVSWGVGCAQRNKPGVYTRLPLFRDWIKENTGV

SEQ ID NO: 76 - protein, 242 aa, Artificial Sequence
  MEMBRANE TYPE SERINE PROTEASE 1 (MT-SP1) protease domain I41S/D96K/F97G/ins97aV/T98P/F99L/C122S/Q175L/Q192N /D217V
VVGGTDADEGEWPWQVSLHALGQGHSCGASLISPNWLVSAAHCYIDDRGFRYSDPTQWTAFLGLHDQSQRSAPGVQERRLKRIISHPFFNKGVPLDYDIALLELEKPAEYSSMVRPISLPDASHVFPAGKAIWVTGWGHTQYGGTGALILQKGEIRVINQTTCENLLPQLITPRMMCVGFLSGGVDSCNGDSGGPLSSVEADGRIFQAGVVSWGVGCAQRNKPGVYTRLPLFRDWIKENTGV

SEQ ID NO: 77 - protein, 241 aa, Artificial Sequence
  MEMBRANE TYPE SERINE PROTEASE 1 (MT-SP1) protease domain I41T/F97W/F99L/C122S/G151N/Q175M/Q192G/D217L
VVGGTDADEGEWPWQVSLHALGQGHTCGASLISPNWLVSAAHCYIDDRGFRYSDPTQWTAFLGLHDQSQRSAPGVQERRLKRIISHPFFNDWTLDYDIALLELEKPAEYSSMVRPISLPDASHVFPAGKAIWVTGWGHTQYGGTNALILQKGEIRVINQTTCENLLPQMITPRMMCVGFLSGGVDSCGGDSGGPLSSVEADGRIFQAGVVSWGLGCAQRNKPGVYTRLPLFRDWIKENTGV

SEQ ID NO: 78 - protein, 241 aa, Artificial Sequence
  MEMBRANE TYPE SERINE PROTEASE 1 (MT-SP1) protease domain I41G/F97L/F99L/C122S/Q175A/Q192T/D217V
VVGGTDADEGEWPWQVSLHALGQGHGCGASLISPNWLVSAAHCYIDDRGFRYSDPTQWTAFLGLHDQSQRSAPGVQERRLKRIISHPFFNDLTLDYDIALLELEKPAEYSSMVRPISLPDASHVFPAGKAIWVTGWGHTQYGGTGALILQKGEIRVINQTTCENLLPQAITPRMMCVGFLSGGVDSCTGDSGGPLSSVEADGRIFQAGVVSWGVGCAQRNKPGVYTRLPLFRDWIKENTGV

SEQ ID NO: 79 - protein, 241 aa, Artificial Sequence
  MEMBRANE TYPE SERINE PROTEASE 1 (MT-SP1) protease domain I41G/F97V/F99L/C122S/G151Q/Q175M/Q192A/D217L
VVGGTDADEGEWPWQVSLHALGQGHGCGASLISPNWLVSAAHCYIDDRGFRYSDPTQWTAFLGLHDQSQRSAPGVQERRLKRIISHPFFNDVTLDYDIALLELEKPAEYSSMVRPISLPDASHVFPAGKAIWVTGWGHTQYGGTQALILQKGEIRVINQTTCENLLPQMITPRMMCVGFLSGGVDSCAGDSGGPLSSVEADGRIFQAGVVSWGLGCAQRNKPGVYTRLPLFRDWIKENTGV

SEQ ID NO: 80 - protein, 241 aa, Artificial Sequence
  MEMBRANE TYPE SERINE PROTEASE 1 (MT-SP1) protease domain I41G/F97I/F99L/C122S/G151L/Q175M/Q192S/D217V
VVGGTDADEGEWPWQVSLHALGQGHGCGASLISPNWLVSAAHCYIDDRGFRYSDPTQWTAFLGLHDQSQRSAPGVQERRLKRIISHPFFNDITLDYDIALLELEKPAEYSSMVRPISLPDASHVFPAGKAIWVTGWGHTQYGGTLALILQKGEIRVINQTTCENLLPQMITPRMMCVGFLSGGVDSCSGDSGGPLSSVEADGRIFQAGVVSWGVGCAQRNKPGVYTRLPLFRDWIKENTGV

SEQ ID NO: 81 - protein, 241 aa, Artificial Sequence
  MEMBRANE TYPE SERINE PROTEASE 1 (MT-SP1) protease domain I41G/F97S/F99L/C122S/G151N/Q175L/Q192G/D217I
VVGGTDADEGEWPWQVSLHALGQGHGCGASLISPNWLVSAAHCYIDDRGFRYSDPTQWTAFLGLHDQSQRSAPGVQERRLKRIISHPFFNDSTLDYDIALLELEKPAEYSSMVRPISLPDASHVFPAGKAIWVTGWGHTQYGGTNALILQKGEIRVINQTTCENLLPQLITPRMMCVGFLSGGVDSCGGDSGGPLSSVEADGRIFQAGVVSWGIGCAQRNKPGVYTRLPLFRDWIKENTGV

SEQ ID NO: 82 - protein, 21 aa, Artificial Sequence
  Buforin II
TRSSRAGLQFPVGRVHRLLRK

SEQ ID NO: 83 - protein, 16 aa, Artificial Sequence
  DPV3
RKKRRRESRKKRRRES

SEQ ID NO: 84 - protein, 17 aa, Artificial Sequence
  DPV6
GRPRESGKKRKRKRLKP

SEQ ID NO: 85 - protein, 15 aa, Artificial Sequence
  DPV7
GKRKKKGKLGKKRDP

SEQ ID NO: 86 - protein, 17 aa, Artificial Sequence
  DPV7b
GKRKKKGKLGKKRPRSR

SEQ ID NO: 87 - protein, 18 aa, Artificial Sequence
  DPV3/10
RKKRRRESRRARRSPRHL

SEQ ID NO: 88 - protein, 19 aa, Artificial Sequence
  DPV10/6
SRRARRSPRESGKKRKRKR

SEQ ID NO: 89 - protein, 19 aa, Artificial Sequence
  DPV1047
VKRGLKLRHVRPRVTRMDV

SEQ ID NO: 90 - protein, 18 aa, Artificial Sequence
  DPV1048
VKRGLKLRHVRPRVTRDV

SEQ ID NO: 91 - protein, 14 aa, Artificial Sequence
  DPV10
SRRARRSPRHLGSG

SEQ ID NO: 92 - protein, 16 aa, Artificial Sequence
  DPV15
LRRERQSRLRRERQSR

SEQ ID NO: 93 - protein, 22 aa, Artificial Sequence
  DPV15b
GAYDLRRRERQSRLRRRERQSR

SEQ ID NO: 94 - protein, 30 aa, Artificial Sequence
  GALA
WEAALAEALAEALAEHLAEALAEALEALAA

SEQ ID NO: 95 - protein, 21 aa, Artificial Sequence
  Fibrinogen beta chain
KGSWYSMRKMSMKIRPFFPQQ

SEQ ID NO: 96 - protein, 20 aa, Artificial Sequence
  Fibrinogen gamma chain precursor
KTRYYSMKKTTMKIIPFNRL

SEQ ID NO: 97 - protein, 20 aa, Artificial Sequence
  Fibrinogen alpha chain
RGADYSLRAVRMKIRPLVTQ

SEQ ID NO: 98 - protein, 24 aa, Artificial Sequence
  hCT(9-32)
LGTYTQDFNKFHTFPQTAIGVGAP

SEQ ID NO: 99 - protein, 12 aa, Artificial Sequence
  HN-1
TSPLNIHNGQKL

SEQ ID NO: 100 - protein, 12 aa, Artificial Sequence
  Influenza virus nucleoprotein (NLS)
NSAAFEDLRVLS

SEQ ID NO: 101 - protein, 30 aa, Artificial Sequence
  KALA
WEAKLAKALAKALAKHLAKALAKALKACEA

SEQ ID NO: 102 - protein, 10 aa, Artificial Sequence
  Ku70
VPMLKPMLKE

SEQ ID NO: 103 - protein, 18 aa, Artificial Sequence
  MAP
KLALKLALKALKAALKLA

SEQ ID NO: 104 - protein, 27 aa, Artificial Sequence
  MPG
GALFLGFLGAAGSTMGAWSQPKKKRKV

SEQ ID NO: 105 - protein, 16 aa, Artificial Sequence
  Human Fibroblast growth factor 4 (Kaposi Fibroblast growth factor)
AAVALLPAVLLALLAP

SEQ ID NO: 106 - protein, 9 aa, Artificial Sequence
  N50 (NLS of NF-kB P50)
VQRKRQKLM

SEQ ID NO: 107 - protein, 21 aa, Artificial Sequence
  Pep-1
KETWWETWWTEWSQPKKKRKV

SEQ ID NO: 108 - protein, 15 aa, Artificial Sequence
  Pep-7
SDLWEMMMVSLACQY

SEQ ID NO: 109 - protein, 16 aa, Artificial Sequence
  Penetratin
RQIKIWFQNRRMKWKK

SEQ ID NO: 110 - protein, 17 aa, Artificial Sequence
  Penetratin variant
GRQIKIWFQNRRMKWKK

SEQ ID NO: 111 - protein, 7 aa, Artificial Sequence
  Short Penetratin
RRMKWKK

SEQ ID NO: 112 - protein, 17 aa, Artificial Sequence
  Penetratin 42-58
ERQIKIWFQNRRMKWKK

SEQ ID NO: 113 - protein, 7 aa, Artificial Sequence
  Poly Arginine - R7
RRRRRRR

SEQ ID NO: 114 - protein, 9 aa, Artificial Sequence
  Poly Arginine - R9
RRRRRRRRR

SEQ ID NO: 115 - protein, 16 aa, Artificial Sequence
  pISL
RVIRVWFQNKRCKDKK

SEQ ID NO: 116 - protein, 28 aa, Artificial Sequence
  Prion mouse PrPc1-28
MANLGYWLLALFVTMWTDVGLCKKRPKP

SEQ ID NO: 117 - protein, 18 aa, Artificial Sequence
  pVEC
LLIILRRRIRKQAHAHSK

SEQ ID NO: 118 - protein, 16 aa, Artificial Sequence
  pVEC variant
LLIILRRRIRKQAHAH

SEQ ID NO: 119 - protein, 18 aa, Artificial Sequence
  SAP
VRLPPPVRLPPPVRLPPP

SEQ ID NO: 120 - protein, 7 aa, Artificial Sequence
  SV-40 (NLS)
PKKKRKV

SEQ ID NO: 121 - protein, 18 aa, Artificial Sequence
  SynB1
RGGRLSYSRRRFSTSTGR

SEQ ID NO: 122 - protein, 10 aa, Artificial Sequence
  SynB3
RRLSYSRRRF

SEQ ID NO: 123 - protein, 17 aa, Artificial Sequence
  SynB4
AWSFRVSYRGISYRRSR

SEQ ID NO: 124 - protein, 14 aa, Artificial Sequence
  Tat 47-60
YGRKKRRQRRRPPQ

SEQ ID NO: 125 - protein, 11 aa, Artificial Sequence
  Tat 47-57
YGRKKRRQRRR

SEQ ID NO: 126 - protein, 10 aa, Artificial Sequence
  Tat 47-56
YGRKKRRQRR

SEQ ID NO: 127 - protein, 9 aa, Artificial Sequence
  Tat 48-56
GRKKRRQRR

SEQ ID NO: 128 - protein, 10 aa, Artificial Sequence
  Tat 48-57
GRKKRRQRRR

SEQ ID NO: 129 - protein, 9 aa, Artificial Sequence
  Tat 49-57
RKKRRQRRR

SEQ ID NO: 130 - protein, 8 aa, Artificial Sequence
  Tat 49-56
RKKRRQRR

SEQ ID NO: 131 - protein, 13 aa, Artificial Sequence
  Tat 48-60
GRKKRRQRRRPPQ

SEQ ID NO: 132 - protein, 5 aa, Artificial Sequence
  Tat 48-52
GRKKR

SEQ ID NO: 133 - protein, 36 aa, Artificial Sequence
  Tat 37-72
CFITKALGISYGRKKRRQRRRPPQFSQTHQVSLSKQ

SEQ ID NO: 134 - protein, 34 aa, Artificial Sequence
  Tat 38-72
FITKALGISYGRKKRRQRRRPQFSQTHQVSLSKQ

SEQ ID NO: 135 - protein, 13 aa, Artificial Sequence
  Tat 47-59
YGRKKRRQRRRPP

SEQ ID NO: 136 - protein, 27 aa, Artificial Sequence
  Transportan
GWTLNSAGYLLGKINLKALAALAKKIL

SEQ ID NO: 137 - protein, 21 aa, Artificial Sequence
  Transportan 10
AGYLLGKINLKALAALAKKIL

SEQ ID NO: 138 - protein, 12 aa, Artificial Sequence
  Transportan derivative
GWTLNSAGYLLG

SEQ ID NO: 139 - protein, 14 aa, Artificial Sequence
  Transportan derivative 2
INLKALAALAKKIL

SEQ ID NO: 140 - protein, 34 aa, Artificial Sequence
  VP22
DAATATRGRSAASRPTERPRAPARSASRPRRPVD

SEQ ID NO: 141 - protein, 26 aa, Artificial Sequence
  VT5
DPKGDPKGVTVTVTVTVTGKGDPKPD

SEQ ID NO: 142 - protein, 27 aa, Artificial Sequence
  Signal Sequence-based peptide
GALFLGWLGAAGSTMGAWSQPKKKRKV

SEQ ID NO: 143 - protein, 18 aa, Artificial Sequence
  Amphiphilic model peptide
KLALKLALKALKAALKLA

SEQ ID NO: 144 - protein, 10 aa, Artificial Sequence
  Bacterial cell wall permeating
KFFKFFKFFK

SEQ ID NO: 145 - protein, 37 aa, Artificial Sequence
  LL- 37
LLGDFFRKSKEKIGKEFKRIVQRIKDFLRNLVPRTES

SEQ ID NO: 146 - protein, 31 aa, Artificial Sequence
  Cecropin P1
SWLSKTAKKLENSAKKRISEGIAIAIQGGPR

SEQ ID NO: 147 - protein, 30 aa, Artificial Sequence
  alpha defensin
ACYCRIPACIAGERRYGTCIYQGRLWAFCC

SEQ ID NO: 148 - protein, 36 aa, Artificial Sequence
  beta defensin
DHYNCVSSGGQCLYSACPIFTKIQGTCYRGKAKCCK

SEQ ID NO: 149 - protein, 11 aa, Artificial Sequence
  Bactenecin
RKCRIWIRVCR

SEQ ID NO: 150 - protein, 42 aa, Artificial Sequence
  PR- 39
RRRPRPPYLPRPRPPPFFPPRLPPRIPPGFPPRFPPRFPGKR

SEQ ID NO: 151 - protein, 13 aa, Artificial Sequence
  Indolicidin
ILPWKWPWWPWRR

SEQ ID NO: 152 - protein, 27 aa, Artificial Sequence
  MPS
GALFLGWLGAAGSTMGAWSQPKKKRKV

SEQ ID NO: 153 - protein, 17 aa, Artificial Sequence
  pIs1
PVIRRVWFQNKRCKDKK

SEQ ID NO: 154 - protein, 241 aa, Artificial Sequence
  MEMBRANE TYPE SERINE PROTEASE 1 (MT-SP1) protease domain F97E/F99L/C122S/D217I/K224N
VVGGTDADEGEWPWQVSLHALGQGHICGASLISPNWLVSAAHCYIDDRGFRYSDPTQWTAFLGLHDQSQRSAPGVQERRLKRIISHPFFNDETLDYDIALLELEKPAEYSSMVRPISLPDASHVFPAGKAIWVTGWGHTQYGGTGALILQKGEIRVINQTTCENLLPQQITPRMMCVGFLSGGVDSCQGDSGGPLSSVEADGRIFQAGVVSWGIGCAQRNNPGVYTRLPLFRDWIKENTGV

SEQ ID NO: 155 - protein, 241 aa, Artificial Sequence
  MEMBRANE TYPE SERINE PROTEASE 1 (MT-SP1) protease domain C122S/G193A
VVGGTDADEGEWPWQVSLHALGQGHICGASLISPNWLVSAAHCYIDDRGFRYSDPTQWTAFLGLHDQSQRSAPGVQERRLKRIISHPFFNDFTFDYDIALLELEKPAEYSSMVRPISLPDASHVFPAGKAIWVTGWGHTQYGGTGALILQKGEIRVINQTTCENLLPQQITPRMMCVGFLSGGVDSCQADSGGPLSSVEADGRIFQAGVVSWGDGCAQRNKPGVYTRLPLFRDWIKENTGV

SEQ ID NO: 156 - protein, 241 aa, Artificial Sequence
  MEMBRANE TYPE SERINE PROTEASE 1 (MT-SP1) protease domain C122S/G193E
VVGGTDADEGEWPWQVSLHALGQGHICGASLISPNWLVSAAHCYIDDRGFRYSDPTQWTAFLGLHDQSQRSAPGVQERRLKRIISHPFFNDFTFDYDIALLELEKPAEYSSMVRPISLPDASHVFPAGKAIWVTGWGHTQYGGTGALILQKGEIRVINQTTCENLLPQQITPRMMCVGFLSGGVDSCQEDSGGPLSSVEADGRIFQAGVVSWGDGCAQRNKPGVYTRLPLFRDWIKENTGV

SEQ ID NO: 157 - protein, 242 aa, Artificial Sequence
  MEMBRANE TYPE SERINE PROTEASE 1 (MT-SP1) protease domain D96_F97delinsWYY/T98P/F99L/C122S
VVGGTDADEGEWPWQVSLHALGQGHICGASLISPNWLVSAAHCYIDDRGFRYSDPTQWTAFLGLHDQSQRSAPGVQERRLKRIISHPFFNWYYPLDYDIALLELEKPAEYSSMVRPISLPDASHVFPAGKAIWVTGWGHTQYGGTGALILQKGEIRVINQTTCENLLPQQITPRMMCVGFLSGGVDSCQGDSGGPLSSVEADGRIFQAGVVSWGDGCAQRNKPGVYTRLPLFRDWIKENTGV

SEQ ID NO: 158 - protein, 241 aa, Artificial Sequence
  MEMBRANE TYPE SERINE PROTEASE 1 (MT-SP1) protease domain F97D/F99L/C122S/Q192G
VVGGTDADEGEWPWQVSLHALGQGHICGASLISPNWLVSAAHCYIDDRGFRYSDPTQWTAFLGLHDQSQRSAPGVQERRLKRIISHPFFNDDTLDYDIALLELEKPAEYSSMVRPISLPDASHVFPAGKAIWVTGWGHTQYGGTGALILQKGEIRVINQTTCENLLPQQITPRMMCVGFLSGGVDSCGGDSGGPLSSVEADGRIFQAGVVSWGDGCAQRNKPGVYTRLPLFRDWIKENTGV

SEQ ID NO: 159 - protein, 241 aa, Artificial Sequence
  MEMBRANE TYPE SERINE PROTEASE 1 (MT-SP1) protease domain H40R/I41H/F97D/F99L/C122S/Q192G
VVGGTDADEGEWPWQVSLHALGQGRHCGASLISPNWLVSAAHCYIDDRGFRYSDPTQWTAFLGLHDQSQRSAPGVQERRLKRIISHPFFNDDTLDYDIALLELEKPAEYSSMVRPISLPDASHVFPAGKAIWVTGWGHTQYGGTGALILQKGEIRVINQTTCENLLPQQITPRMMCVGFLSGGVDSCGGDSGGPLSSVEADGRIFQAGVVSWGDGCAQRNKPGVYTRLPLFRDWIKENTGV

SEQ ID NO: 160 - protein, 241 aa, Artificial Sequence
  MEMBRANE TYPE SERINE PROTEASE 1 (MT-SP1) protease domain C122S/G151N/G193A
VVGGTDADEGEWPWQVSLHALGQGHICGASLISPNWLVSAAHCYIDDRGFRYSDPTQWTAFLGLHDQSQRSAPGVQERRLKRIISHPFFNDFTFDYDIALLELEKPAEYSSMVRPISLPDASHVFPAGKAIWVTGWGHTQYGGTNALILQKGEIRVINQTTCENLLPQQITPRMMCVGFLSGGVDSCQADSGGPLSSVEADGRIFQAGVVSWGDGCAQRNKPGVYTRLPLFRDWIKENTGV

SEQ ID NO: 161 - protein, 241 aa, Artificial Sequence
  MEMBRANE TYPE SERINE PROTEASE 1 (MT-SP1) protease domain H40R/I41H/C122S/G151N
VVGGTDADEGEWPWQVSLHALGQGRHCGASLISPNWLVSAAHCYIDDRGFRYSDPTQWTAFLGLHDQSQRSAPGVQERRLKRIISHPFFNDFTFDYDIALLELEKPAEYSSMVRPISLPDASHVFPAGKAIWVTGWGHTQYGGTNALILQKGEIRVINQTTCENLLPQQITPRMMCVGFLSGGVDSCQGDSGGPLSSVEADGRIFQAGVVSWGDGCAQRNKPGVYTRLPLFRDWIKENTGV

SEQ ID NO: 162 - protein, 241 aa, Artificial Sequence
  MEMBRANE TYPE SERINE PROTEASE 1 (MT-SP1) protease domain H40R/I41H/F97D/C122S/G151N
VVGGTDADEGEWPWQVSLHALGQGRHCGASLISPNWLVSAAHCYIDDRGFRYSDPTQWTAFLGLHDQSQRSAPGVQERRLKRIISHPFFNDDTFDYDIALLELEKPAEYSSMVRPISLPDASHVFPAGKAIWVTGWGHTQYGGTNALILQKGEIRVINQTTCENLLPQQITPRMMCVGFLSGGVDSCQGDSGGPLSSVEADGRIFQAGVVSWGDGCAQRNKPGVYTRLPLFRDWIKENTGV

SEQ ID NO: 163 - protein, 241 aa, Artificial Sequence
  MEMBRANE TYPE SERINE PROTEASE 1 (MT-SP1) protease domain H40R/I41H/F97E/C122S
VVGGTDADEGEWPWQVSLHALGQGRHCGASLISPNWLVSAAHCYIDDRGFRYSDPTQWTAFLGLHDQSQRSAPGVQERRLKRIISHPFFNDETFDYDIALLELEKPAEYSSMVRPISLPDASHVFPAGKAIWVTGWGHTQYGGTGALILQKGEIRVINQTTCENLLPQQITPRMMCVGFLSGGVDSCQGDSGGPLSSVEADGRIFQAGVVSWGDGCAQRNKPGVYTRLPLFRDWIKENTGV

SEQ ID NO: 164 - protein, 242 aa, Artificial Sequence
  MEMBRANE TYPE SERINE PROTEASE 1 (MT-SP1) protease domain F97T/ins97aE/T98G/F99L/C122S/Q175L/Q192E
VVGGTDADEGEWPWQVSLHALGQGHICGASLISPNWLVSAAHCYIDDRGFRYSDPTQWTAFLGLHDQSQRSAPGVQERRLKRIISHPFFNDTEGLDYDIALLELEKPAEYSSMVRPISLPDASHVFPAGKAIWVTGWGHTQYGGTGALILQKGEIRVINQTTCENLLPQLITPRMMCVGFLSGGVDSCEGDSGGPLSSVEADGRIFQAGVVSWGDGCAQRNKPGVYTRLPLFRDWIKENTGV

SEQ ID NO: 165 - protein, 241 aa, Artificial Sequence
  MEMBRANE TYPE SERINE PROTEASE 1 (MT-SP1) protease domain H40R/I41H/Y60gL/F97D/F99L/C122S/G151N/Q175M/D217I/ K224S
VVGGTDADEGEWPWQVSLHALGQGRICGASLISPNWLVSAAHCYIDDRGFRLSDPTQWTAFLGLHDQSQRSAPGVQERRLKRIISHPFFNDDTLDYDIALLELEKPAEYSSMVRPISLPDASHVFPAGKAIWVTGWGHTQYGGTNALILQKGEIRVINQTTCENLLPQMITPRMMCVGFLSGGVDSCQGDSGGPLSSVEADGRIFQAGVVSWGIGCAQRNSPGVYTRLPLFRDWIKENTGV

SEQ ID NO: 166 - protein, 241 aa, Artificial Sequence
  MEMBRANE TYPE SERINE PROTEASE 1 (MT-SP1) protease domain H40R/I41H/F97D/F99L/C122S/G151D/Q192G
VVGGTDADEGEWPWQVSLHALGQGRHCGASLISPNWLVSAAHCYIDDRGFRYSDPTQWTAFLGLHDQSQRSAPGVQERRLKRIISHPFFNDDTLDYDIALLELEKPAEYSSMVRPISLPDASHVFPAGKAIWVTGWGHTQYGGTNALILQKGEIRVINQTTCENLLPQQITPRMMCVGFLSGGVDSCGGDSGGPLSSVEADGRIFQAGVVSWGDGCAQRNKPGVYTRLPLFRDWIKENTGV

SEQ ID NO: 167 - protein, 241 aa, Artificial Sequence
  MEMBRANE TYPE SERINE PROTEASE 1 (MT-SP1) protease domain H40R/I41H/F97D/F99L/Q192G
VVGGTDADEGEWPWQVSLHALGQGRHCGASLISPNWLVSAAHCYIDDRGFRYSDPTQWTAFLGLHDQSQRSAPGVQERRLKRIISHPFFNDDTLDYDIALLELEKPAEYSSMVRPICLPDASHVFPAGKAIWVTGWGHTQYGGTGALILQKGEIRVINQTTCENLLPQQITPRMMCVGFLSGGVDSCGGDSGGPLSSVEADGRIFQAGVVSWGDGCAQRNKPGVYTRLPLFRDWIKENTGV

SEQ ID NO: 168 - protein, 241 aa, Artificial Sequence
  MEMBRANE TYPE SERINE PROTEASE 1 (MT-SP1) protease domain H40R/I41H/Y60gH/F97D/F99L/C122S/G151N/Q175A/Q192H/ D217I/K224R
VVGGTDADEGEWPWQVSLHALGQGRHCGASLISPNWLVSAAHCYIDDRGFRHSDPTQWTAFLGLHDQSQRSAPGVQERRLKRIISHPFFNDDTLDYDIALLELEKPAEYSSMVRPISLPDASHVFPAGKAIWVTGWGHTQYGGTNALILQKGEIRVINQTTCENLLPQAITPRMMCVGFLSGGVDSCHGDSGGPLSSVEADGRIFQAGVVSWGIGCAQRNRPGVYTRLPLFRDWIKENTGV

SEQ ID NO: 169 - protein, 241 aa, Artificial Sequence
  MEMBRANE TYPE SERINE PROTEASE 1 (MT-SP1) protease domain H40R/I41H/Y60gF/F97D/F99L/C122S/Q192G/D217M/K224R
VVGGTDADEGEWPWQVSLHALGQGRHCGASLISPNWLVSAAHCYIDDRGFRFSDPTQWTAFLGLHDQSQRSAPGVQERRLKRIISHPFFNDDTLDYDIALLELEKPAEYSSMVRPISLPDASHVFPAGKAIWVTGWGHTQYGGTGALILQKGEIRVINQTTCENLLPQQITPRMMCVGFLSGGVDSCGGDSGGPLSSVEADGRIFQAGVVSWGMGCAQRNRPGVYTRLPLFRDWIKENTGV

SEQ ID NO: 170 - protein, 241 aa, Artificial Sequence
  MEMBRANE TYPE SERINE PROTEASE 1 (MT-SP1) protease domain H40R/I41H/Y60gF/F97D/F99L/C122S/Q192G/D217R/K224A
VVGGTDADEGEWPWQVSLHALGQGRHCGASLISPNWLVSAAHCYIDDRGFRFSDPTQWTAFLGLHDQSQRSAPGVQERRLKRIISHPFFNDDTLDYDIALLELEKPAEYSSMVRPISLPDASHVFPAGKAIWVTGWGHTQYGGTGALILQKGEIRVINQTTCENLLPQQITPRMMCVGFLSGGVDSCGGDSGGPLSSVEADGRIFQAGVVSWGRGCAQRNAPGVYTRLPLFRDWIKENTGV

SEQ ID NO: 171 - protein, 241 aa, Artificial Sequence
  MEMBRANE TYPE SERINE PROTEASE 1 (MT-SP1) protease domain H40R/I41H/F97D/F99L/C122S/Q175L/Q192G/D217K/K224A
VVGGTDADEGEWPWQVSLHALGQGRHCGASLISPNWLVSAAHCYIDDRGFRYSDPTQWTAFLGLHDQSQRSAPGVQERRLKRIISHPFFNDDTLDYDIALLELEKPAEYSSMVRPISLPDASHVFPAGKAIWVTGWGHTQYGGTGALILQKGEIRVINQTTCENLLPQLITPRMMCVGFLSGGVDSCGGDSGGPLSSVEADGRIFQAGVVSWGKGCAQRNAPGVYTRLPLFRDWIKENTGV

SEQ ID NO: 172 - protein, 241 aa, Artificial Sequence
  MEMBRANE TYPE SERINE PROTEASE 1 (MT-SP1) protease domain H40R/I41H/F97D/F99L/C122S/Q175M/Q192G/D217V/K224Y
VVGGTDADEGEWPWQVSLHALGQGRHCGASLISPNWLVSAAHCYIDDRGFRYSDPTQWTAFLGLHDQSQRSAPGVQERRLKRIISHPFFNDDTLDYDIALLELEKPAEYSSMVRPISLPDASHVFPAGKAIWVTGWGHTQYGGTGALILQKGEIRVINQTTCENLLPQMITPRMMCVGFLSGGVDSCGGDSGGPLSSVEADGRIFQAGVVSWGVGCAQRNYPGVYTRLPLFRDWIKENTGV

SEQ ID NO: 173 - protein, 241 aa, Artificial Sequence
  MEMBRANE TYPE SERINE PROTEASE 1 (MT-SP1) protease domain H40R/I41H/F97D/F99L/C122S/Q175K/Q192G/D217I/K224H
VVGGTDADEGEWPWQVSLHALGQGRHCGASLISPNWLVSAAHCYIDDRGFRYSDPTQWTAFLGLHDQSQRSAPGVQERRLKRIISHPFFNDDTLDYDIALLELEKPAEYSSMVRPISLPDASHVFPAGKAIWVTGWGHTQYGGTGALILQKGEIRVINQTTCENLLPQKITPRMMCVGFLSGGVDSCGGDSGGPLSSVEADGRIFQAGVVSWGIGCAQRNHPGVYTRLPLFRDWIKENTGV

SEQ ID NO: 174 - protein, 241 aa, Artificial Sequence
  MEMBRANE TYPE SERINE PROTEASE 1 (MT-SP1) protease domain H40R/I41H/F97D/F99L/C122S/Q175M/Q192G/D217S
VVGGTDADEGEWPWQVSLHALGQGRHCGASLISPNWLVSAAHCYIDDRGFRYSDPTQWTAFLGLHDQSQRSAPGVQERRLKRIISHPFFNDDTLDYDIALLELEKPAEYSSMVRPISLPDASHVFPAGKAIWVTGWGHTQYGGTGALILQKGEIRVINQTTCENLLPQMITPRMMCVGFLSGGVDSCGGDSGGPLSSVEADGRIFQAGVVSWGSGCAQRNKPGVYTRLPLFRDWIKENTGV

SEQ ID NO: 175 - protein, 241 aa, Artificial Sequence
  MEMBRANE TYPE SERINE PROTEASE 1 (MT-SP1) protease domain H40R/I41H/Y60gF/F97D/F99L/C122S/Q175M/Q192G/D217W/ K224R
VVGGTDADEGEWPWQVSLHALGQGRHCGASLISPNWLVSAAHCYIDDRGFRFSDPTQWTAFLGLHDQSQRSAPGVQERRLKRIISHPFFNDDTLDYDIALLELEKPAEYSSMVRPISLPDASHVFPAGKAIWVTGWGHTQYGGTGALILQKGEIRVINQTTCENLLPQMITPRMMCVGFLSGGVDSCGGDSGGPLSSVEADGRIFQAGVVSWGWGCAQRNRPGVYTRLPLFRDWIKENTGV

SEQ ID NO: 176 - protein, 241 aa, Artificial Sequence
  MEMBRANE TYPE SERINE PROTEASE 1 (MT-SP1) protease domain H40R/I41H/Y60gN/F97D/F99L/C122S/G151N/Q175K/Q192S/ D217S/K224L
VVGGTDADEGEWPWQVSLHALGQGRHCGASLISPNWLVSAAHCYIDDRGFRNSDPTQWTAFLGLHDQSQRSAPGVQERRLKRIISHPFFNDDTLDYDIALLELEKPAEYSSMVRPISLPDASHVFPAGKAIWVTGWGHTQYGGTNALILQKGEIRVINQTTCENLLPQKITPRMMCVGFLSGGVDSCSGDSGGPLSSVEADGRIFQAGVVSWGSGCAQRNLPGVYTRLPLFRDWIKENTGV

SEQ ID NO: 177 - protein, 241 aa, Artificial Sequence
  MEMBRANE TYPE SERINE PROTEASE 1 (MT-SP1) protease domain H40R/I41H/Y60gH/F97D/F99L/C122S/Q175M/Q192G/D217I/ K224L
VVGGTDADEGEWPWQVSLHALGQGRHCGASLISPNWLVSAAHCYIDDRGFRHSDPTQWTAFLGLHDQSQRSAPGVQERRLKRIISHPFFNDDTLDYDIALLELEKPAEYSSMVRPISLPDASHVFPAGKAIWVTGWGHTQYGGTGALILQKGEIRVINQTTCENLLPQMITPRMMCVGFLSGGVDSCGGDSGGPLSSVEADGRIFQAGVVSWGIGCAQRNLPGVYTRLPLFRDWIKENTGV

SEQ ID NO: 178 - protein, 241 aa, Artificial Sequence
  MEMBRANE TYPE SERINE PROTEASE 1 (MT-SP1) protease domain H40K/I41L/Y60gF/F97D/F99L/C122S/G151N/Q175R
VVGGTDADEGEWPWQVSLHALGQGKLCGASLISPNWLVSAAHCYIDDRGFRFSDPTQWTAFLGLHDQSQRSAPGVQERRLKRIISHPFFNDDTLDYDIALLELEKPAEYSSMVRPISLPDASHVFPAGKAIWVTGWGHTQYGGTNALILQKGEIRVINQTTCENLLPQRITPRMMCVGFLSGGVDSCQGDSGGPLSSVEADGRIFQAGVVSWGDGCAQRNKPGVYTRLPLFRDWIKENTGV

SEQ ID NO: 179 - protein, 241 aa, Artificial Sequence
  MEMBRANE TYPE SERINE PROTEASE 1 (MT-SP1) protease domain H40R/I41H/Y60gL/F97D/F99L/C122S/G151N
VVGGTDADEGEWPWQVSLHALGQGRHCGASLISPNWLVSAAHCYIDDRGFRLSDPTQWTAFLGLHDQSQRSAPGVQERRLKRIISHPFFNDDTLDYDIALLELEKPAEYSSMVRPISLPDASHVFPAGKAIWVTGWGHTQYGGTNALILQKGEIRVINQTTCENLLPQQITPRMMCVGFLSGGVDSCQGDSGGPLSSVEADGRIFQAGVVSWGDGCAQRNKPGVYTRLPLFRDWIKENTGV

SEQ ID NO: 180 - protein, 241 aa, Artificial Sequence
  MEMBRANE TYPE SERINE PROTEASE 1 (MT-SP1) protease domain H40K/I41M/Y60gG/F97D/F99L/C122S/G151N/Q175R/Q192R/ D217V/K224S
VVGGTDADEGEWPWQVSLHALGQGKMCGASLISPNWLVSAAHCYIDDRGFRGSDPTQWTAFLGLHDQSQRSAPGVQERRLKRIISHPFFNDDTLDYDIALLELEKPAEYSSMVRPISLPDASHVFPAGKAIWVTGWGHTQYGGTNALILQKGEIRVINQTTCENLLPQRITPRMMCVGFLSGGVDSCRGDSGGPLSSVEADGRIFQAGVVSWGVGCAQRNSPGVYTRLPLFRDWIKENTGV

SEQ ID NO: 181 - protein, 241 aa, Artificial Sequence
  MEMBRANE TYPE SERINE PROTEASE 1 (MT-SP1) protease domain H40K/I41M/Y60gF/F97D/F99L/C122S/G151N/Q175L/Q192D
VVGGTDADEGEWPWQVSLHALGQGKMCGASLISPNWLVSAAHCYIDDRGFRFSDPTQWTAFLGLHDQSQRSAPGVQERRLKRIISHPFFNDDTLDYDIALLELEKPAEYSSMVRPISLPDASHVFPAGKAIWVTGWGHTQYGGTNALILQKGEIRVINQTTCENLLPQLITPRMMCVGFLSGGVDSCDGDSGGPLSSVEADGRIFQAGVVSWGDGCAQRNKPGVYTRLPLFRDWIKENTGV

SEQ ID NO: 182 - protein, 241 aa, Artificial Sequence
  MEMBRANE TYPE SERINE PROTEASE 1 (MT-SP1) protease domain H40R/I41H/F97D/C122S/G151N/Q175M/Q192A/D217S/K224R
VVGGTDADEGEWPWQVSLHALGQGRHCGASLISPNWLVSAAHCYIDDRGFRYSDPTQWTAFLGLHDQSQRSAPGVQERRLKRIISHPFFNDDTFDYDIALLELEKPAEYSSMVRPISLPDASHVFPAGKAIWVTGWGHTQYGGTNALILQKGEIRVINQTTCENLLPQMITPRMMCVGFLSGGVDSCAGDSGGPLSSVEADGRIFQAGVVSWGSGCAQRNRPGVYTRLPLFRDWIKENTGV

SEQ ID NO: 183 - protein, 241 aa, Artificial Sequence
  MEMBRANE TYPE SERINE PROTEASE 1 (MT-SP1) protease domain H40R/I41H/Y60gH/F97D/F99L/C122S/Q175M/Q192G/D217I/ K224R
VVGGTDADEGEWPWQVSLHALGQGRHCGASLISPNWLVSAAHCYIDDRGFRHSDPTQWTAFLGLHDQSQRSAPGVQERRLKRIISHPFFNDDTLDYDIALLELEKPAEYSSMVRPISLPDASHVFPAGKAIWVTGWGHTQYGGTGALILQKGEIRVINQTTCENLLPQMITPRMMCVGFLSGGVDSCGGDSGGPLSSVEADGRIFQAGVVSWGIGCAQRNRPGVYTRLPLFRDWIKENTGV

SEQ ID NO: 184 - protein, 241 aa, Artificial Sequence
  MEMBRANE TYPE SERINE PROTEASE 1 (MT-SP1) protease domain H40R/I41H/F97D/F99L/C122S/G151D/Q175M/Q192G/D217V
VVGGTDADEGEWPWQVSLHALGQGRHCGASLISPNWLVSAAHCYIDDRGFRYSDPTQWTAFLGLHDQSQRSAPGVQERRLKRIISHPFFNDDTLDYDIALLELEKPAEYSSMVRPISLPDASHVFPAGKAIWVTGWGHTQYGGTDALILQKGEIRVINQTTCENLLPQMITPRMMCVGFLSGGVDSCGGDSGGPLSSVEADGRIFQAGVVSWGVGCAQRNKPGVYTRLPLFRDWIKENTGV

SEQ ID NO: 185 - protein, 241 aa, Artificial Sequence
  MEMBRANE TYPE SERINE PROTEASE 1 (MT-SP1) protease domain H40R/I41H/F97D/F99L/C122S/G151N/Q175M/Q192A/D217N/ K224R
VVGGTDADEGEWPWQVSLHALGQGRHCGASLISPNWLVSAAHCYIDDRGFRYSDPTQWTAFLGLHDQSQRSAPGVQERRLKRIISHPFFNDDTLDYDIALLELEKPAEYSSMVRPISLPDASHVFPAGKAIWVTGWGHTQYGGTNALILQKGEIRVINQTTCENLLPQMITPRMMCVGFLSGGVDSCAGDSGGPLSSVEADGRIFQAGVVSWGNGCAQRNRPGVYTRLPLFRDWIKENTGV

SEQ ID NO: 186 - protein, 241 aa, Artificial Sequence
  MEMBRANE TYPE SERINE PROTEASE 1 (MT-SP1) protease domain H40R/I41H/F97D/F99L/C122S/G151N/Q175L/Q192A/D217N/ K224R
VVGGTDADEGEWPWQVSLHALGQGRHCGASLISPNWLVSAAHCYIDDRGFRYSDPTQWTAFLGLHDQSQRSAPGVQERRLKRIISHPFFNDDTLDYDIALLELEKPAEYSSMVRPISLPDASHVFPAGKAIWVTGWGHTQYGGTNALILQKGEIRVINQTTCENLLPQLITPRMMCVGFLSGGVDSCAGDSGGPLSSVEADGRIFQAGVVSWGNGCAQRNRPGVYTRLPLFRDWIKENTGV

SEQ ID NO: 187 - protein, 241 aa, Artificial Sequence
  MEMBRANE TYPE SERINE PROTEASE 1 (MT-SP1) protease domain H40K/I41M/F97D/F99L/C122S/G151N/Q175M/Q192D/D217N/ K224R
VVGGTDADEGEWPWQVSLHALGQGKMCGASLISPNWLVSAAHCYIDDRGFRYSDPTQWTAFLGLHDQSQRSAPGVQERRLKRIISHPFFNDDTLDYDIALLELEKPAEYSSMVRPISLPDASHVFPAGKAIWVTGWGHTQYGGTNALILQKGEIRVINQTTCENLLPQMITPRMMCVGFLSGGVDSCDGDSGGPLSSVEADGRIFQAGVVSWGNGCAQRNRPGVYTRLPLFRDWIKENTGV

SEQ ID NO: 188 - protein, 241 aa, Artificial Sequence
  MEMBRANE TYPE SERINE PROTEASE 1 (MT-SP1) protease domain H40K/I41M/F97D/F99L/C122S/G151N/Q175L/Q192A/D217N/ K224R
VVGGTDADEGEWPWQVSLHALGQGKMCGASLISPNWLVSAAHCYIDDRGFRYSDPTQWTAFLGLHDQSQRSAPGVQERRLKRIISHPFFNDDTLDYDIALLELEKPAEYSSMVRPISLPDASHVFPAGKAIWVTGWGHTQYGGTNALILQKGEIRVINQTTCENLLPQLITPRMMCVGFLSGGVDSCAGDSGGPLSSVEADGRIFQAGVVSWGNGCAQRNRPGVYTRLPLFRDWIKENTGV

SEQ ID NO: 189 - protein, 241 aa, Artificial Sequence
  MEMBRANE TYPE SERINE PROTEASE 1 (MT-SP1) protease domain H40R/I41H/F97D/F99L/C122S/Q175M/Q192D/D217N/K224R
VVGGTDADEGEWPWQVSLHALGQGRHCGASLISPNWLVSAAHCYIDDRGFRYSDPTQWTAFLGLHDQSQRSAPGVQERRLKRIISHPFFNDDTLDYDIALLELEKPAEYSSMVRPISLPDASHVFPAGKAIWVTGWGHTQYGGTGALILQKGEIRVINQTTCENLLPQMITPRMMCVGFLSGGVDSCDGDSGGPLSSVEADGRIFQAGVVSWGNGCAQRNRPGVYTRLPLFRDWIKENTGV

SEQ ID NO: 190 - protein, 241 aa, Artificial Sequence
  MEMBRANE TYPE SERINE PROTEASE 1 (MT-SP1) protease domain H40R/I41H/F97D/F99L/C122S/Q175M/D217N/K224R
VVGGTDADEGEWPWQVSLHALGQGRHCGASLISPNWLVSAAHCYIDDRGFRYSDPTQWTAFLGLHDQSQRSAPGVQERRLKRIISHPFFNDDTLDYDIALLELEKPAEYSSMVRPISLPDASHVFPAGKAIWVTGWGHTQYGGTGALILQKGEIRVINQTTCENLLPQMITPRMMCVGFLSGGVDSCQGDSGGPLSSVEADGRIFQAGVVSWGNGCAQRNRPGVYTRLPLFRDWIKENTGV

SEQ ID NO: 191 - protein, 241 aa, Artificial Sequence
  MEMBRANE TYPE SERINE PROTEASE 1 (MT-SP1) protease domain H40K/I41M/F97D/F99L/C122S/Q175M/Q192D/D217N/K224R
VVGGTDADEGEWPWQVSLHALGQGKMCGASLISPNWLVSAAHCYIDDRGFRYSDPTQWTAFLGLHDQSQRSAPGVQERRLKRIISHPFFNDDTLDYDIALLELEKPAEYSSMVRPISLPDASHVFPAGKAIWVTGWGHTQYGGTGALILQKGEIRVINQTTCENLLPQMITPRMMCVGFLSGGVDSCDGDSGGPLSSVEADGRIFQAGVVSWGNGCAQRNRPGVYTRLPLFRDWIKENTGV

SEQ ID NO: 192 - protein, 241 aa, Artificial Sequence
  MEMBRANE TYPE SERINE PROTEASE 1 (MT-SP1) protease domain H40K/I41M/F97D/F99L/C122S/G151N/Q175M/Q192A/D217N/ K224R
VVGGTDADEGEWPWQVSLHALGQGKMCGASLISPNWLVSAAHCYIDDRGFRYSDPTQWTAFLGLHDQSQRSAPGVQERRLKRIISHPFFNDDTLDYDIALLELEKPAEYSSMVRPISLPDASHVFPAGKAIWVTGWGHTQYGGTNALILQKGEIRVINQTTCENLLPQMITPRMMCVGFLSGGVDSCAGDSGGPLSSVEADGRIFQAGVVSWGNGCAQRNRPGVYTRLPLFRDWIKENTGV

SEQ ID NO: 193 - protein, 241 aa, Artificial Sequence
  MEMBRANE TYPE SERINE PROTEASE 1 (MT-SP1) protease domain H40K/I41M/F97D/F99L/C122S/Q175M/D217N/K224R
VVGGTDADEGEWPWQVSLHALGQGKMCGASLISPNWLVSAAHCYIDDRGFRYSDPTQWTAFLGLHDQSQRSAPGVQERRLKRIISHPFFNDDTLDYDIALLELEKPAEYSSMVRPISLPDASHVFPAGKAIWVTGWGHTQYGGTGALILQKGEIRVINQTTCENLLPQMITPRMMCVGFLSGGVDSCQGDSGGPLSSVEADGRIFQAGVVSWGNGCAQRNRPGVYTRLPLFRDWIKENTGV

SEQ ID NO: 194 - protein, 242 aa, Artificial Sequence
  MEMBRANE TYPE SERINE PROTEASE 1 (MT-SP1) protease domain H40R/I41H/F97T/ins97aE/T98G/F99L/C122S/Q175L/Q192E
VVGGTDADEGEWPWQVSLHALGQGRHCGASLISPNWLVSAAHCYIDDRGFRYSDPTQWTAFLGLHDQSQRSAPGVQERRLKRIISHPFFNDTEGLDYDIALLELEKPAEYSSMVRPISLPDASHVFPAGKAIWVTGWGHTQYGGTGALILQKGEIRVINQTTCENLLPQLITPRMMCVGFLSGGVDSCEGDSGGPLSSVEADGRIFQAGVVSWGDGCAQRNKPGVYTRLPLFRDWIKENTGV

SEQ ID NO: 195 - protein, 242 aa, Artificial Sequence
  MEMBRANE TYPE SERINE PROTEASE 1 (MT-SP1) protease domain H40R/I41H/F97T/ins97aE/T98G/F99L/C122S/Q175L/Q192G
VVGGTDADEGEWPWQVSLHALGQGRHCGASLISPNWLVSAAHCYIDDRGFRYSDPTQWTAFLGLHDQSQRSAPGVQERRLKRIISHPFFNDTEGLDYDIALLELEKPAEYSSMVRPISLPDASHVFPAGKAIWVTGWGHTQYGGTGALILQKGEIRVINQTTCENLLPQLITPRMMCVGFLSGGVDSCGGDSGGPLSSVEADGRIFQAGVVSWGDGCAQRNKPGVYTRLPLFRDWIKENTGV

SEQ ID NO: 196 - protein, 242 aa, Artificial Sequence
  MEMBRANE TYPE SERINE PROTEASE 1 (MT-SP1) protease domain H40R/I41H/F97E/ins97aE/T98G/F99L/C122S/Q175L/Q192G
VVGGTDADEGEWPWQVSLHALGQGRHCGASLISPNWLVSAAHCYIDDRGFRYSDPTQWTAFLGLHDQSQRSAPGVQERRLKRIISHPFFNDEEGLDYDIALLELEKPAEYSSMVRPISLPDASHVFPAGKAIWVTGWGHTQYGGTGALILQKGEIRVINQTTCENLLPQLITPRMMCVGFLSGGVDSCGGDSGGPLSSVEADGRIFQAGVVSWGDGCAQRNKPGVYTRLPLFRDWIKENTGV

SEQ ID NO: 197 - protein, 241 aa, Artificial Sequence
  MEMBRANE TYPE SERINE PROTEASE 1 (MT-SP1) protease domain H40R/I41H/F97D/F99L/C122S/G151N/Q192H
VVGGTDADEGEWPWQVSLHALGQGRHCGASLISPNWLVSAAHCYIDDRGFRYSDPTQWTAFLGLHDQSQRSAPGVQERRLKRIISHPFFNDDTLDYDIALLELEKPAEYSSMVRPISLPDASHVFPAGKAIWVTGWGHTQYGGTNALILQKGEIRVINQTTCENLLPQQITPRMMCVGFLSGGVDSCHGDSGGPLSSVEADGRIFQAGVVSWGDGCAQRNKPGVYTRLPLFRDWIKENTGV

SEQ ID NO: 198 - protein, 241 aa, Artificial Sequence
  MEMBRANE TYPE SERINE PROTEASE 1 (MT-SP1) protease domain H40R/I41H/F97D/F99L/C122S/G151N/L153R
VVGGTDADEGEWPWQVSLHALGQGRHCGASLISPNWLVSAAHCYIDDRGFRYSDPTQWTAFLGLHDQSQRSAPGVQERRLKRIISHPFFNDDTLDYDIALLELEKPAEYSSMVRPISLPDASHVFPAGKAIWVTGWGHTQYGGTNARILQKGEIRVINQTTCENLLPQQITPRMMCVGFLSGGVDSCQGDSGGPLSSVEADGRIFQAGVVSWGDGCAQRNKPGVYTRLPLFRDWIKENTGV

SEQ ID NO: 199 - protein, 241 aa, Artificial Sequence
  MEMBRANE TYPE SERINE PROTEASE 1 (MT-SP1) protease domain H40R/I41H/F97D/C122S/G151N/L153R/V202M
VVGGTDADEGEWPWQVSLHALGQGRHCGASLISPNWLVSAAHCYIDDRGFRYSDPTQWTAFLGLHDQSQRSAPGVQERRLKRIISHPFFNDDTFDYDIALLELEKPAEYSSMVRPISLPDASHVFPAGKAIWVTGWGHTQYGGTNARILQKGEIRVINQTTCENLLPQQITPRMMCVGFLSGGVDSCQGDSGGPLSSMEADGRIFQAGVVSWGDGCAQRNKPGVYTRLPLFRDWIKENTGV

SEQ ID NO: 200 - protein, 241 aa, Artificial Sequence
  MEMBRANE TYPE SERINE PROTEASE 1 (MT-SP1) protease domain H40R/I41H/F97D/F99L/C122S/G151N/Q192H/P232S
VVGGTDADEGEWPWQVSLHALGQGRHCGASLISPNWLVSAAHCYIDDRGFRYSDPTQWTAFLGLHDQSQRSAPGVQERRLKRIISHPFFNDDTLDYDIALLELEKPAEYSSMVRPISLPDASHVFPAGKAIWVTGWGHTQYGGTNALILQKGEIRVINQTTCENLLPQQITPRMMCVGFLSGGVDSCHGDSGGPLSSVEADGRIFQAGVVSWGDGCAQRNKPGVYTRLSLFRDWIKENTGV

SEQ ID NO: 201 - protein, 242 aa, Artificial Sequence
  MEMBRANE TYPE SERINE PROTEASE 1 (MT-SP1) protease domain H40R/I41H/F97D/ins97aE/T98G/F99L/C122S/Q175L/Q192G
VVGGTDADEGEWPWQVSLHALGQGRHCGASLISPNWLVSAAHCYIDDRGFRYSDPTQWTAFLGLHDQSQRSAPGVQERRLKRIISHPFFNDDEGLDYDIALLELEKPAEYSSMVRPISLPDASHVFPAGKAIWVTGWGHTQYGGTGALILQKGEIRVINQTTCENLLPQLITPRMMCVGFLSGGVDSCGGDSGGPLSSVEADGRIFQAGVVSWGDGCAQRNKPGVYTRLPLFRDWIKENTGV

SEQ ID NO: 202 - protein, 241 aa, Artificial Sequence
  MEMBRANE TYPE SERINE PROTEASE 1 (MT-SP1) protease domain H40R/I41H/F97D/C122S/G151N/L153R
VVGGTDADEGEWPWQVSLHALGQGRHCGASLISPNWLVSAAHCYIDDRGFRYSDPTQWTAFLGLHDQSQRSAPGVQERRLKRIISHPFFNDDTFDYDIALLELEKPAEYSSMVRPISLPDASHVFPAGKAIWVTGWGHTQYGGTNARILQKGEIRVINQTTCENLLPQQITPRMMCVGFLSGGVDSCQGDSGGPLSSVEADGRIFQAGVVSWGDGCAQRNKPGVYTRLPLFRDWIKENTGV

SEQ ID NO: 203 - protein, 241 aa, Artificial Sequence
  MEMBRANE TYPE SERINE PROTEASE 1 (MT-SP1) protease domain H40K/I41M/F99L/C122S/T150A/G151R/Q192G
VVGGTDADEGEWPWQVSLHALGQGKMCGASLISPNWLVSAAHCYIDDRGFRYSDPTQWTAFLGLHDQSQRSAPGVQERRLKRIISHPFFNDFTLDYDIALLELEKPAEYSSMVRPISLPDASHVFPAGKAIWVTGWGHTQYGGARALILQKGEIRVINQTTCENLLPQQITPRMMCVGFLSGGVDSCGGDSGGPLSSVEADGRIFQAGVVSWGDGCAQRNKPGVYTRLPLFRDWIKENTGV

SEQ ID NO: 204 - protein, 241 aa, Artificial Sequence
  MEMBRANE TYPE SERINE PROTEASE 1 (MT-SP1) protease domain H40R/I41H/F97D/C122S/G133D/G151N
VVGGTDADEGEWPWQVSLHALGQGRHCGASLISPNWLVSAAHCYIDDRGFRYSDPTQWTAFLGLHDQSQRSAPGVQERRLKRIISHPFFNDDTFDYDIALLELEKPAEYSSMVRPISLPDASHVFPADKAIWVTGWGHTQYGGTNALILQKGEIRVINQTTCENLLPQQITPRMMCVGFLSGGVDSCQGDSGGPLSSVEADGRIFQAGVVSWGDGCAQRNKPGVYTRLPLFRDWIKENTGV

SEQ ID NO: 205 - protein, 241 aa, Artificial Sequence
  MEMBRANE TYPE SERINE PROTEASE 1 (MT-SP1) protease domain I41R/F99L/C122S/Q192G
VVGGTDADEGEWPWQVSLHALGQGHRCGASLISPNWLVSAAHCYIDDRGFRYSDPTQWTAFLGLHDQSQRSAPGVQERRLKRIISHPFFNDFTLDYDIALLELEKPAEYSSMVRPISLPDASHVFPAGKAIWVTGWGHTQYGGTGALILQKGEIRVINQTTCENLLPQQITPRMMCVGFLSGGVDSCGGDSGGPLSSVEADGRIFQAGVVSWGDGCAQRNKPGVYTRLPLFRDWIKENTGV

SEQ ID NO: 206 - protein, 241 aa, Artificial Sequence
  MEMBRANE TYPE SERINE PROTEASE 1 (MT-SP1) protease domain H40R/I41H/F99L/C122S/G151K/Q192G
VVGGTDADEGEWPWQVSLHALGQGRHCGASLISPNWLVSAAHCYIDDRGFRYSDPTQWTAFLGLHDQSQRSAPGVQERRLKRIISHPFFNDFTLDYDIALLELEKPAEYSSMVRPISLPDASHVFPAGKAIWVTGWGHTQYGGTKALILQKGEIRVINQTTCENLLPQQITPRMMCVGFLSGGVDSCGGDSGGPLSSVEADGRIFQAGVVSWGDGCAQRNKPGVYTRLPLFRDWIKENTGV

SEQ ID NO: 207 - protein, 242 aa, Artificial Sequence
  MEMBRANE TYPE SERINE PROTEASE 1 (MT-SP1) protease domain I41R/ins97aE/F97T/T98G/F99L/C122S/G151E/Q175L/Q192 E
VVGGTDADEGEWPWQVSLHALGQGHRCGASLISPNWLVSAAHCYIDDRGFRYSDPTQWTAFLGLHDQSQRSAPGVQERRLKRIISHPFFNDTEGLDYDIALLELEKPAEYSSMVRPISLPDASHVFPAGKAIWVTGWGHTQYGGTEALILQKGEIRVINQTTCENLLPQLITPRMMCVGFLSGGVDSCEGDSGGPLSSVEADGRIFQAGVVSWGDGCAQRNKPGVYTRLPLFRDWIKENTGV

SEQ ID NO: 208 - protein, 241 aa, Artificial Sequence
  MEMBRANE TYPE SERINE PROTEASE 1 (MT-SP1) protease domain K86R/K110R/C122S/K134R/K157R/K224R/K239R
VVGGTDADEGEWPWQVSLHALGQGHICGASLISPNWLVSAAHCYIDDRGFRYSDPTQWTAFLGLHDQSQRSAPGVQERRLRRIISHPFFNDFTFDYDIALLELERPAEYSSMVRPISLPDASHVFPAGRAIWVTGWGHTQYGGTGALILQRGEIRVINQTTCENLLPQQITPRMMCVGFLSGGVDSCQGDSGGPLSSVEADGRIFQAGVVSWGDGCAQRNRPGVYTRLPLFRDWIRENTGV

SEQ ID NO: 209 - protein, 241 aa, Artificial Sequence
  MEMBRANE TYPE SERINE PROTEASE 1 (MT-SP1) protease domain H40R/I41H/K86R/F97D/K110R/C122S/K134R/G151N/K157R/ K224R/K239R
VVGGTDADEGEWPWQVSLHALGQGRHCGASLISPNWLVSAAHCYIDDRGFRYSDPTQWTAFLGLHDQSQRSAPGVQERRLRRIISHPFFNDDTFDYDIALLELERPAEYSSMVRPISLPDASHVFPAGRAIWVTGWGHTQYGGTNALILQRGEIRVINQTTCENLLPQQITPRMMCVGFLSGGVDSCQGDSGGPLSSVEADGRIFQAGVVSWGDGCAQRNRPGVYTRLPLFRDWIRENTGV

SEQ ID NO: 210 - protein, 242 aa, Artificial Sequence
  MEMBRANE TYPE SERINE PROTEASE 1 (MT-SP1) protease domain K86R/F97T/ins97aE/T98G/F99L/K110R/C122S/K134R/K157 R/Q175L/Q192E/K224R/K239R
VVGGTDADEGEWPWQVSLHALGQGHICGASLISPNWLVSAAHCYIDDRGFRYSDPTQWTAFLGLHDQSQRSAPGVQERRLRRIISHPFFNDTEGLDYDIALLELERPAEYSSMVRPISLPDASHVFPAGRAIWVTGWGHTQYGGTGALILQRGEIRVINQTTCENLLPQLITPRMMCVGFLSGGVDSCEGDSGGPLSSVEADGRIFQAGVVSWGDGCAQRNRPGVYTRLPLFRDWIRENTGV

SEQ ID NO: 211 - protein, 241 aa, Artificial Sequence
  MEMBRANE TYPE SERINE PROTEASE 1 (MT-SP1) protease domain H40R/I41H/F97D/F99L/C122S/Q175R/Q192G/D217H/K224S
VVGGTDADEGEWPWQVSLHALGQGRHCGASLISPNWLVSAAHCYIDDRGFRYSDPTQWTAFLGLHDQSQRSAPGVQERRLKRIISHPFFNDDTLDYDIALLELEKPAEYSSMVRPISLPDASHVFPAGKAIWVTGWGHTQYGGTGALILQKGEIRVINQTTCENLLPQRITPRMMCVGFLSGGVDSCGGDSGGPLSSVEADGRIFQAGVVSWGHGCAQRNSPGVYTRLPLFRDWIKENTGV

SEQ ID NO: 212 - protein, 241 aa, Artificial Sequence
  MEMBRANE TYPE SERINE PROTEASE 1 (MT-SP1) protease domain H40R/I41H/F97D/F99L/C122S/Q192G/D217I/K224S
VVGGTDADEGEWPWQVSLHALGQGRHCGASLISPNWLVSAAHCYIDDRGFRYSDPTQWTAFLGLHDQSQRSAPGVQERRLKRIISHPFFNDDTLDYDIALLELEKPAEYSSMVRPISLPDASHVFPAGKAIWVTGWGHTQYGGTGALILQKGEIRVINQTTCENLLPQQITPRMMCVGFLSGGVDSCGGDSGGPLSSVEADGRIFQAGVVSWGIGCAQRNSPGVYTRLPLFRDWIKENTGV

SEQ ID NO: 213 - protein, 241 aa, Artificial Sequence
  MEMBRANE TYPE SERINE PROTEASE 1 (MT-SP1) protease domain H40R/I41H/F97D/F99L/C122S/Q192G/D217K/K224A
VVGGTDADEGEWPWQVSLHALGQGRHCGASLISPNWLVSAAHCYIDDRGFRYSDPTQWTAFLGLHDQSQRSAPGVQERRLKRIISHPFFNDDTLDYDIALLELEKPAEYSSMVRPISLPDASHVFPAGKAIWVTGWGHTQYGGTGALILQKGEIRVINQTTCENLLPQQITPRMMCVGFLSGGVDSCGGDSGGPLSSVEADGRIFQAGVVSWGKGCAQRNAPGVYTRLPLFRDWIKENTGV

SEQ ID NO: 214 - protein, 241 aa, Artificial Sequence
  MEMBRANE TYPE SERINE PROTEASE 1 (MT-SP1) protease domain H40R/I41H/F97D/F99L/C122S/Q175R/Q192G/D217E/K224R
VVGGTDADEGEWPWQVSLHALGQGRHCGASLISPNWLVSAAHCYIDDRGFRYSDPTQWTAFLGLHDQSQRSAPGVQERRLKRIISHPFFNDDTLDYDIALLELEKPAEYSSMVRPISLPDASHVFPAGKAIWVTGWGHTQYGGTGALILQKGEIRVINQTTCENLLPQRITPRMMCVGFLSGGVDSCGGDSGGPLSSVEADGRIFQAGVVSWGEGCAQRNRPGVYTRLPLFRDWIKENTGV

SEQ ID NO: 215 - protein, 241 aa, Artificial Sequence
  MEMBRANE TYPE SERINE PROTEASE 1 (MT-SP1) protease domain H40R/I41H/F97D/C122S/Q175R/Q192G/D217I/K224Q
VVGGTDADEGEWPWQVSLHALGQGRHCGASLISPNWLVSAAHCYIDDRGFRYSDPTQWTAFLGLHDQSQRSAPGVQERRLKRIISHPFFNDDTFDYDIALLELEKPAEYSSMVRPISLPDASHVFPAGKAIWVTGWGHTQYGGTGALILQKGEIRVINQTTCENLLPQRITPRMMCVGFLSGGVDSCGGDSGGPLSSVEADGRIFQAGVVSWGIGCAQRNQPGVYTRLPLFRDWIKENTGV

SEQ ID NO: 216 - protein, 241 aa, Artificial Sequence
  MEMBRANE TYPE SERINE PROTEASE 1 (MT-SP1) protease domain H40P/I41R/F99L/C122S/Q192G
VVGGTDADEGEWPWQVSLHALGQGPRCGASLISPNWLVSAAHCYIDDRGFRYSDPTQWTAFLGLHDQSQRSAPGVQERRLKRIISHPFFNDFTLDYDIALLELEKPAEYSSMVRPISLPDASHVFPAGKAIWVTGWGHTQYGGTGALILQKGEIRVINQTTCENLLPQQITPRMMCVGFLSGGVDSCGGDSGGPLSSVEADGRIFQAGVVSWGDGCAQRNKPGVYTRLPLFRDWIKENTGV

SEQ ID NO: 217 - protein, 241 aa, Artificial Sequence
  MEMBRANE TYPE SERINE PROTEASE 1 (MT-SP1) protease domain H40P/I41R/F99L/C122S/G151K/Q192G
VVGGTDADEGEWPWQVSLHALGQGPRCGASLISPNWLVSAAHCYIDDRGFRYSDPTQWTAFLGLHDQSQRSAPGVQERRLKRIISHPFFNDFTLDYDIALLELEKPAEYSSMVRPISLPDASHVFPAGKAIWVTGWGHTQYGGTKALILQKGEIRVINQTTCENLLPQQITPRMMCVGFLSGGVDSCGGDSGGPLSSVEADGRIFQAGVVSWGDGCAQRNKPGVYTRLPLFRDWIKENTGV

SEQ ID NO: 218 - protein, 241 aa, Artificial Sequence
  MEMBRANE TYPE SERINE PROTEASE 1 (MT-SP1) protease domain H40R/I41H/F99L/C122S/G151E/Q192G
VVGGTDADEGEWPWQVSLHALGQGRHCGASLISPNWLVSAAHCYIDDRGFRYSDPTQWTAFLGLHDQSQRSAPGVQERRLKRIISHPFFNDFTLDYDIALLELEKPAEYSSMVRPISLPDASHVFPAGKAIWVTGWGHTQYGGTEALILQKGEIRVINQTTCENLLPQQITPRMMCVGFLSGGVDSCGGDSGGPLSSVEADGRIFQAGVVSWGDGCAQRNKPGVYTRLPLFRDWIKENTGV

SEQ ID NO: 219 - protein, 242 aa, Artificial Sequence
  MEMBRANE TYPE SERINE PROTEASE 1 (MT-SP1) protease domain I41R/ins97aE/F97T/T98G/F99L/C122S/G151D/Q175L/Q192 E
VVGGTDADEGEWPWQVSLHALGQGHRCGASLISPNWLVSAAHCYIDDRGFRYSDPTQWTAFLGLHDQSQRSAPGVQERRLKRIISHPFFNDTEGLDYDIALLELEKPAEYSSMVRPISLPDASHVFPAGKAIWVTGWGHTQYGGTDALILQKGEIRVINQTTCENLLPQLITPRMMCVGFLSGGVDSCEGDSGGPLSSVEADGRIFQAGVVSWGDGCAQRNKPGVYTRLPLFRDWIKENTGV

SEQ ID NO: 220 - protein, 242 aa, Artificial Sequence
  MEMBRANE TYPE SERINE PROTEASE 1 (MT-SP1) protease domain I41R/ins97aE/F97T/T98G/F99L/C122S/G151D/Q175T/Q192 E
VVGGTDADEGEWPWQVSLHALGQGHRCGASLISPNWLVSAAHCYIDDRGFRYSDPTQWTAFLGLHDQSQRSAPGVQERRLKRIISHPFFNDTEGLDYDIALLELEKPAEYSSMVRPISLPDASHVFPAGKAIWVTGWGHTQYGGTDALILQKGEIRVINQTTCENLLPQTITPRMMCVGFLSGGVDSCEGDSGGPLSSVEADGRIFQAGVVSWGDGCAQRNKPGVYTRLPLFRDWIKENTGV

SEQ ID NO: 221 - protein, 242 aa, Artificial Sequence
  MEMBRANE TYPE SERINE PROTEASE 1 (MT-SP1) protease domain I41R/ins97aE/F97T/T98G/F99L/C122S/G151D/Q175T/Q192 D
VVGGTDADEGEWPWQVSLHALGQGHRCGASLISPNWLVSAAHCYIDDRGFRYSDPTQWTAFLGLHDQSQRSAPGVQERRLKRIISHPFFNDTEGLDYDIALLELEKPAEYSSMVRPISLPDASHVFPAGKAIWVTGWGHTQYGGTDALILQKGEIRVINQTTCENLLPQTITPRMMCVGFLSGGVDSCDGDSGGPLSSVEADGRIFQAGVVSWGDGCAQRNKPGVYTRLPLFRDWIKENTGV

SEQ ID NO: 222 - protein, 242 aa, Artificial Sequence
  MEMBRANE TYPE SERINE PROTEASE 1 (MT-SP1) protease domain I41R/ins97aE/F97T/T98G/F99L/C122S/G151E/Q175T/Q192 D
VVGGTDADEGEWPWQVSLHALGQGHRCGASLISPNWLVSAAHCYIDDRGFRYSDPTQWTAFLGLHDQSQRSAPGVQERRLKRIISHPFFNDTEGLDYDIALLELEKPAEYSSMVRPISLPDASHVFPAGKAIWVTGWGHTQYGGTEALILQKGEIRVINQTTCENLLPQTITPRMMCVGFLSGGVDSCDGDSGGPLSSVEADGRIFQAGVVSWGDGCAQRNKPGVYTRLPLFRDWIKENTGV

SEQ ID NO: 223 - protein, 242 aa, Artificial Sequence
  MEMBRANE TYPE SERINE PROTEASE 1 (MT-SP1) protease domain H40P/I41R/ins97aE/F97T/T98G/F99L/C122S/Q175L/Q192E
VVGGTDADEGEWPWQVSLHALGQGPRCGASLISPNWLVSAAHCYIDDRGFRYSDPTQWTAFLGLHDQSQRSAPGVQERRLKRIISHPFFNDTEGLDYDIALLELEKPAEYSSMVRPISLPDASHVFPAGKAIWVTGWGHTQYGGTGALILQKGEIRVINQTTCENLLPQLITPRMMCVGFLSGGVDSCEGDSGGPLSSVEADGRIFQAGVVSWGDGCAQRNKPGVYTRLPLFRDWIKENTGV

SEQ ID NO: 224 - protein, 242 aa, Artificial Sequence
  MEMBRANE TYPE SERINE PROTEASE 1 (MT-SP1) protease domain H40P/I41R/ins97aE/F97T/T98G/F99L/C122S/G151D/Q175L /Q192E
VVGGTDADEGEWPWQVSLHALGQGPRCGASLISPNWLVSAAHCYIDDRGFRYSDPTQWTAFLGLHDQSQRSAPGVQERRLKRIISHPFFNDTEGLDYDIALLELEKPAEYSSMVRPISLPDASHVFPAGKAIWVTGWGHTQYGGTDALILQKGEIRVINQTTCENLLPQLITPRMMCVGFLSGGVDSCEGDSGGPLSSVEADGRIFQAGVVSWGDGCAQRNKPGVYTRLPLFRDWIKENTGV

SEQ ID NO: 225 - protein, 242 aa, Artificial Sequence; identical to SEQ ID NO: 21
  MEMBRANE TYPE SERINE PROTEASE 1 (MT-SP1) protease domain I41R/ins97aE/F97T/T98G/F99L/C122S/G151N/Q175L/Q192 E

SEQ ID NO: 226 - protein, 242 aa, Artificial Sequence
  MEMBRANE TYPE SERINE PROTEASE 1 (MT-SP1) protease domain I41R/ins97aE/F97T/T98G/F99L/C122S/G151N/Q175L/Q192 D
VVGGTDADEGEWPWQVSLHALGQGHRCGASLISPNWLVSAAHCYIDDRGFRYSDPTQWTAFLGLHDQSQRSAPGVQERRLKRIISHPFFNDTEGLDYDIALLELEKPAEYSSMVRPISLPDASHVFPAGKAIWVTGWGHTQYGGTNALILQKGEIRVINQTTCENLLPQLITPRMMCVGFLSGGVDSCDGDSGGPLSSVEADGRIFQAGVVSWGDGCAQRNKPGVYTRLPLFRDWIKENTGV

SEQ ID NO: 227 - protein, 242 aa, Artificial Sequence
  MEMBRANE TYPE SERINE PROTEASE 1 (MT-SP1) protease domain I41R/ins97aE/F97T/T98G/F99L/C122S/G151N/Q175T/Q192 E
VVGGTDADEGEWPWQVSLHALGQGHRCGASLISPNWLVSAAHCYIDDRGFRYSDPTQWTAFLGLHDQSQRSAPGVQERRLKRIISHPFFNDTEGLDYDIALLELEKPAEYSSMVRPISLPDASHVFPAGKAIWVTGWGHTQYGGTNALILQKGEIRVINQTTCENLLPQTITPRMMCVGFLSGGVDSCEGDSGGPLSSVEADGRIFQAGVVSWGDGCAQRNKPGVYTRLPLFRDWIKENTGV

SEQ ID NO: 228 - protein, 242 aa, Artificial Sequence
  MEMBRANE TYPE SERINE PROTEASE 1 (MT-SP1) protease domain I41R/ins97aE/F97T/T98G/F99L/C122S/G151N/Q175T/Q192 D
VVGGTDADEGEWPWQVSLHALGQGHRCGASLISPNWLVSAAHCYIDDRGFRYSDPTQWTAFLGLHDQSQRSAPGVQERRLKRIISHPFFNDTEGLDYDIALLELEKPAEYSSMVRPISLPDASHVFPAGKAIWVTGWGHTQYGGTNALILQKGEIRVINQTTCENLLPQTITPRMMCVGFLSGGVDSCDGDSGGPLSSVEADGRIFQAGVVSWGDGCAQRNKPGVYTRLPLFRDWIKENTGV

SEQ ID NO: 229 - protein, 242 aa, Artificial Sequence
  MEMBRANE TYPE SERINE PROTEASE 1 (MT-SP1) protease domain I41R/ins97aE/F97T/T98G/F99L/C122S/Q175L/Q192E
VVGGTDADEGEWPWQVSLHALGQGHRCGASLISPNWLVSAAHCYIDDRGFRYSDPTQWTAFLGLHDQSQRSAPGVQERRLKRIISHPFFNDTEGLDYDIALLELEKPAEYSSMVRPISLPDASHVFPAGKAIWVTGWGHTQYGGTGALILQKGEIRVINQTTCENLLPQLITPRMMCVGFLSGGVDSCEGDSGGPLSSVEADGRIFQAGVVSWGDGCAQRNKPGVYTRLPLFRDWIKENTGV

SEQ ID NO: 230 - protein, 241 aa, Artificial Sequence
  MEMBRANE TYPE SERINE PROTEASE 1 (MT-SP1) protease domain H40P/I41R/F99L/C122S/G151E/Q192G
VVGGTDADEGEWPWQVSLHALGQGPRCGASLISPNWLVSAAHCYIDDRGFRYSDPTQWTAFLGLHDQSQRSAPGVQERRLKRIISHPFFNDFTLDYDIALLELEKPAEYSSMVRPISLPDASHVFPAGKAIWVTGWGHTQYGGTEALILQKGEIRVINQTTCENLLPQQITPRMMCVGFLSGGVDSCGGDSGGPLSSVEADGRIFQAGVVSWGDGCAQRNKPGVYTRLPLFRDWIKENTGV

SEQ ID NO: 231 - protein, 242 aa, Artificial Sequence
  MEMBRANE TYPE SERINE PROTEASE 1 (MT-SP1) protease domain I41R/F97T/ins97aE/T98G/F99L/C122S/G151E/Q175T/Q192 E
VVGGTDADEGEWPWQVSLHALGQGHRCGASLISPNWLVSAAHCYIDDRGFRYSDPTQWTAFLGLHDQSQRSAPGVQERRLKRIISHPFFNDTEGLDYDIALLELEKPAEYSSMVRPISLPDASHVFPAGKAIWVTGWGHTQYGGTEALILQKGEIRVINQTTCENLLPQTITPRMMCVGFLSGGVDSCEGDSGGPLSSVEADGRIFQAGVVSWGDGCAQRNKPGVYTRLPLFRDWIKENTGV

SEQ ID NO: 232 - protein, 242 aa, Artificial Sequence
  MEMBRANE TYPE SERINE PROTEASE 1 (MT-SP1) protease domain I41R/F97T/ins97aE/T98G/F99L/C122S/G151N/Q175S/Q192 E
VVGGTDADEGEWPWQVSLHALGQGHRCGASLISPNWLVSAAHCYIDDRGFRYSDPTQWTAFLGLHDQSQRSAPGVQERRLKRIISHPFFNDTEGLDYDIALLELEKPAEYSSMVRPISLPDASHVFPAGKAIWVTGWGHTQYGGTNALILQKGEIRVINQTTCENLLPQSITPRMMCVGFLSGGVDSCEGDSGGPLSSVEADGRIFQAGVVSWGDGCAQRNKPGVYTRLPLFRDWIKENTGV

SEQ ID NO: 233 - protein, 242 aa, Artificial Sequence
  MEMBRANE TYPE SERINE PROTEASE 1 (MT-SP1) protease domain I41R/F97T/ins97aE/T98G/F99L/C122S/G151N/Q175I/Q192 E
VVGGTDADEGEWPWQVSLHALGQGHRCGASLISPNWLVSAAHCYIDDRGFRYSDPTQWTAFLGLHDQSQRSAPGVQERRLKRIISHPFFNDTEGLDYDIALLELEKPAEYSSMVRPISLPDASHVFPAGKAIWVTGWGHTQYGGTNALILQKGEIRVINQTTCENLLPQIITPRMMCVGFLSGGVDSCEGDSGGPLSSVEADGRIFQAGVVSWGDGCAQRNKPGVYTRLPLFRDWIKENTGV

SEQ ID NO: 234 - protein, 241 aa, Artificial Sequence
  MEMBRANE TYPE SERINE PROTEASE 1 (MT-SP1) protease domain H40R/I41H/Y60gF/F97D/F99L/C122S/Q175K/Q192G/D217R/ K224Q
VVGGTDADEGEWPWQVSLHALGQGRHCGASLISPNWLVSAAHCYIDDRGFRFSDPTQWTAFLGLHDQSQRSAPGVQERRLKRIISHPFFNDDTLDYDIALLELEKPAEYSSMVRPISLPDASHVFPAGKAIWVTGWGHTQYGGTGALILQKGEIRVINQTTCENLLPQKITPRMMCVGFLSGGVDSCGGDSGGPLSSVEADGRIFQAGVVSWGRGCAQRNQPGVYTRLPLFRDWIKENTGV

SEQ ID NO: 235 - protein, 241 aa, Artificial Sequence
  MEMBRANE TYPE SERINE PROTEASE 1 (MT-SP1) protease domain H40R/I41H/F97D/F99L/C122S/Q175L/Q192G/D217Q/K224R
VVGGTDADEGEWPWQVSLHALGQGRICGASLISPNWLVSAAHCYIDDRGFRYSDPTQWTAFLGLHDQSQRSAPGVQERRLKRIISHPFFNDDTLDYDIALLELEKPAEYSSMVRPISLPDASHVFPAGKAIWVTGWGHTQYGGTGALILQKGEIRVINQTTCENLLPQLITPRMMCVGFLSGGVDSCGGDSGGPLSSVEADGRIFQAGVVSWGQGCAQRNRPGVYTRLPLFRDWIKENTGV

SEQ ID NO: 236 - protein, 241 aa, Artificial Sequence
  MEMBRANE TYPE SERINE PROTEASE 1 (MT-SP1) protease domain H40R/I41H/F97D/F99L/C122S/G151N/Q192N/D217L/K224R
VVGGTDADEGEWPWQVSLHALGQGRHCGASLISPNWLVSAAHCYIDDRGFRYSDPTQWTAFLGLHDQSQRSAPGVQERRLKRIISHPFFNDDTLDYDIALLELEKPAEYSSMVRPISLPDASHVFPAGKAIWVTGWGHTQYGGTNALILQKGEIRVINQTTCENLLPQQITPRMMCVGFLSGGVDSCNGDSGGPLSSVEADGRIFQAGVVSWGLGCAQRNRPGVYTRLPLFRDWIKENTGV

SEQ ID NO: 237 - protein, 241 aa, Artificial Sequence
  MEMBRANE TYPE SERINE PROTEASE 1 (MT-SP1) protease domain H40R/I41H/F97D/F99L/C122S/G151N/Q192H/D217K/K224A
VVGGTDADEGEWPWQVSLHALGQGRHCGASLISPNWLVSAAHCYIDDRGFRYSDPTQWTAFLGLHDQSQRSAPGVQERRLKRIISHPFFNDDTLDYDIALLELEKPAEYSSMVRPISLPDASHVFPAGKAIWVTGWGHTQYGGTNALILQKGEIRVINQTTCENLLPQQITPRMMCVGFLSGGVDSCHGDSGGPLSSVEADGRIFQAGVVSWGKGCAQRNAPGVYTRLPLFRDWIKENTGV

SEQ ID NO: 238 - protein, 242 aa, Artificial Sequence
  MEMBRANE TYPE SERINE PROTEASE 1 (MT-SP1) protease domain ins97aV/F97D/T98P/F99L/C122S/Q192G
VVGGTDADEGEWPWQVSLHALGQGHICGASLISPNWLVSAAHCYIDDRGFRYSDPTQWTAFLGLHDQSQRSAPGVQERRLKRIISHPFFNDDVPLDYDIALLELEKPAEYSSMVRPISLPDASHVFPAGKAIWVTGWGHTQYGGTGALILQKGEIRVINQTTCENLLPQQITPRMMCVGFLSGGVDSCGGDSGGPLSSVEADGRIFQAGVVSWGDGCAQRNKPGVYTRLPLFRDWIKENTGV

SEQ ID NO: 239 - protein, 242 aa, Artificial Sequence
  MEMBRANE TYPE SERINE PROTEASE 1 (MT-SP1) protease domain F97N/ins97aT/T98Y/F99N/C122S
VVGGTDADEGEWPWQVSLHALGQGHICGASLISPNWLVSAAHCYIDDRGFRYSDPTQWTAFLGLHDQSQRSAPGVQERRLKRIISHPFFNDNTYNDYDIALLELEKPAEYSSMVRPISLPDASHVFPAGKAIWVTGWGHTQYGGTGALILQKGEIRVINQTTCENLLPQQITPRMMCVGFLSGGVDSCQGDSGGPLSSVEADGRIFQAGVVSWGDGCAQRNKPGVYTRLPLFRDWIKENTGV

SEQ ID NO: 240 - protein, 242 aa, Artificial Sequence
  MEMBRANE TYPE SERINE PROTEASE 1 (MT-SP1) protease domain F97M/ins97aD/T98D/F99L/C122S/Q192T
VVGGTDADEGEWPWQVSLHALGQGHICGASLISPNWLVSAAHCYIDDRGFRYSDPTQWTAFLGLHDQSQRSAPGVQERRLKRIISHPFFNDMDDLDYDIALLELEKPAEYSSMVRPISLPDASHVFPAGKAIWVTGWGHTQYGGTGALILQKGEIRVINQTTCENLLPQQITPRMMCVGFLSGGVDSCTGDSGGPLSSVEADGRIFQAGVVSWGDGCAQRNKPGVYTRLPLFRDWIKENTGV

SEQ ID NO: 241 - protein, 242 aa, Artificial Sequence
  MEMBRANE TYPE SERINE PROTEASE 1 (MT-SP1) protease domain ins97aV/F97Q/T98P/F99L/C122S/Q175F/Q192D
VVGGTDADEGEWPWQVSLHALGQGHICGASLISPNWLVSAAHCYIDDRGFRYSDPTQWTAFLGLHDQSQRSAPGVQERRLKRIISHPFFNDQVPLDYDIALLELEKPAEYSSMVRPISLPDASHVFPAGKAIWVTGWGHTQYGGTGALILQKGEIRVINQTTCENLLPQFITPRMMCVGFLSGGVDSCDGDSGGPLSSVEADGRIFQAGVVSWGDGCAQRNKPGVYTRLPLFRDWIKENTGV

SEQ ID NO: 242 - protein, 242 aa, Artificial Sequence
  MEMBRANE TYPE SERINE PROTEASE 1 (MT-SP1) protease domain ins97aD/F97T/T98S/F99L/C122S/Q192E/D217Y/K224R
VVGGTDADEGEWPWQVSLHALGQGHICGASLISPNWLVSAAHCYIDDRGFRYSDPTQWTAFLGLHDQSQRSAPGVQERRLKRIISHPFFNDTDSLDYDIALLELEKPAEYSSMVRPISLPDASHVFPAGKAIWVTGWGHTQYGGTGALILQKGEIRVINQTTCENLLPQQITPRMMCVGFLSGGVDSCEGDSGGPLSSVEADGRIFQAGVVSWGYGCAQRNRPGVYTRLPLFRDWIKENTGV

SEQ ID NO: 243 - protein, 242 aa, Artificial Sequence
  MEMBRANE TYPE SERINE PROTEASE 1 (MT-SP1) protease domain ins97aN/F97H/T98D/F99L/C122S/Q192E/D217Q/K224S
VVGGTDADEGEWPWQVSLHALGQGHICGASLISPNWLVSAAHCYIDDRGFRYSDPTQWTAFLGLHDQSQRSAPGVQERRLKRIISHPFFNDHNDLDYDIALLELEKPAEYSSMVRPISLPDASHVFPAGKAIWVTGWGHTQYGGTGALILQKGEIRVINQTTCENLLPQQITPRMMCVGFLSGGVDSCEGDSGGPLSSVEADGRIFQAGVVSWGQGCAQRNSPGVYTRLPLFRDWIKENTGV

SEQ ID NO: 244 - protein, 242 aa, Artificial Sequence
  MEMBRANE TYPE SERINE PROTEASE 1 (MT-SP1) protease domain F97Q/ins97aT/T98M/C122S/Q192E/D217R/K224L
VVGGTDADEGEWPWQVSLHALGQGHICGASLISPNWLVSAAHCYIDDRGFRYSDPTQWTAFLGLHDQSQRSAPGVQERRLKRIISHPFFNDQTMFDYDIALLELEKPAEYSSMVRPISLPDASHVFPAGKAIWVTGWGHTQYGGTGALILQKGEIRVINQTTCENLLPQQITPRMMCVGFLSGGVDSCEGDSGGPLSSVEADGRIFQAGVVSWGRGCAQRNLPGVYTRLPLFRDWIKENTGV

SEQ ID NO: 245 - protein, 242 aa, Artificial Sequence
  MEMBRANE TYPE SERINE PROTEASE 1 (MT-SP1) protease domain ins97aD/F97Q/T98G/F99L/C122S/Q175L/Q192E/D217F/K22 4S
VVGGTDADEGEWPWQVSLHALGQGHICGASLISPNWLVSAAHCYIDDRGFRYSDPTQWTAFLGLHDQSQRSAPGVQERRLKRIISHPFFNDQDGLDYDIALLELEKPAEYSSMVRPISLPDASHVFPAGKAIWVTGWGHTQYGGTGALILQKGEIRVINQTTCENLLPQLITPRMMCVGFLSGGVDSCEGDSGGPLSSVEADGRIFQAGVVSWGFGCAQRNSPGVYTRLPLFRDWIKENTGV

SEQ ID NO: 246 - protein, 242 aa, Artificial Sequence
  MEMBRANE TYPE SERINE PROTEASE 1 (MT-SP1) protease domain ins97aD/F97G/T98N/F99L/C122S/Q192E/D217Y/K224R
VVGGTDADEGEWPWQVSLHALGQGHICGASLISPNWLVSAAHCYIDDRGFRYSDPTQWTAFLGLHDQSQRSAPGVQERRLKRIISHPFFNDGDNLDYDIALLELEKPAEYSSMVRPISLPDASHVFPAGKAIWVTGWGHTQYGGTGALILQKGEIRVINQTTCENLLPQQITPRMMCVGFLSGGVDSCEGDSGGPLSSVEADGRIFQAGVVSWGYGCAQRNRPGVYTRLPLFRDWIKENTGV

SEQ ID NO: 247 - protein, 242 aa, Artificial Sequence
  MEMBRANE TYPE SERINE PROTEASE 1 (MT-SP1) protease domain ins97aE/F97Y/T98S/F99L/C122S/Q192T/D217Q/K224R
VVGGTDADEGEWPWQVSLHALGQGHICGASLISPNWLVSAAHCYIDDRGFRYSDPTQWTAFLGLHDQSQRSAPGVQERRLKRIISHPFFNDYESLDYDIALLELEKPAEYSSMVRPISLPDASHVFPAGKAIWVTGWGHTQYGGTGALILQKGEIRVINQTTCENLLPQQITPRMMCVGFLSGGVDSCTGDSGGPLSSVEADGRIFQAGVVSWGQGCAQRNRPGVYTRLPLFRDWIKENTGV

SEQ ID NO: 248 - protein, 242 aa, Artificial Sequence
  MEMBRANE TYPE SERINE PROTEASE 1 (MT-SP1) protease domain ins97aG/F97N/T98D/F99L/C122S/Q192E/D217H/K224A
VVGGTDADEGEWPWQVSLHALGQGHICGASLISPNWLVSAAHCYIDDRGFRYSDPTQWTAFLGLHDQSQRSAPGVQERRLKRIISHPFFNDNGDLDYDIALLELEKPAEYSSMVRPISLPDASHVFPAGKAIWVTGWGHTQYGGTGALILQKGEIRVINQTTCENLLPQQITPRMMCVGFLSGGVDSCEGDSGGPLSSVEADGRIFQAGVVSWGHGCAQRNAPGVYTRLPLFRDWIKENTGV

SEQ ID NO: 249 - protein, 242 aa, Artificial Sequence
  MEMBRANE TYPE SERINE PROTEASE 1 (MT-SP1) protease domain ins97aA/F97G/T98N/F99L/C122S/Q175M/Q192T/K224A
VVGGTDADEGEWPWQVSLHALGQGHICGASLISPNWLVSAAHCYIDDRGFRYSDPTQWTAFLGLHDQSQRSAPGVQERRLKRIISHPFFNDGANLDYDIALLELEKPAEYSSMVRPISLPDASHVFPAGKAIWVTGWGHTQYGGTGALILQKGEIRVINQTTCENLLPQMITPRMMCVGFLSGGVDSCTGDSGGPLSSVEADGRIFQAGVVSWGDGCAQRNAPGVYTRLPLFRDWIKENTGV

SEQ ID NO: 250 - protein, 242 aa, Artificial Sequence
  MEMBRANE TYPE SERINE PROTEASE 1 (MT-SP1) protease domain I41R/ins97aE/F97T/T98G/F99L/C122S/G151N/Q175S/Q192 D
VVGGTDADEGEWPWQVSLHALGQGHRCGASLISPNWLVSAAHCYIDDRGFRYSDPTQWTAFLGLHDQSQRSAPGVQERRLKRIISHPFFNDTEGLDYDIALLELEKPAEYSSMVRPISLPDASHVFPAGKAIWVTGWGHTQYGGTNALILQKGEIRVINQTTCENLLPQSITPRMMCVGFLSGGVDSCDGDSGGPLSSVEADGRIFQAGVVSWGDGCAQRNKPGVYTRLPLFRDWIKENTGV

SEQ ID NO: 251 - protein, 242 aa, Artificial Sequence
  MEMBRANE TYPE SERINE PROTEASE 1 (MT-SP1) protease domain I41R/F97T/ins97aE/T98G/F99L/C122S/G151N/Q175I/Q192 D
VVGGTDADEGEWPWQVSLHALGQGHRCGASLISPNWLVSAAHCYIDDRGFRYSDPTQWTAFLGLHDQSQRSAPGVQERRLKRIISHPFFNDTEGLDYDIALLELEKPAEYSSMVRPISLPDASHVFPAGKAIWVTGWGHTQYGGTNALILQKGEIRVINQTTCENLLPQIITPRMMCVGFLSGGVDSCDGDSGGPLSSVEADGRIFQAGVVSWGDGCAQRNKPGVYTRLPLFRDWIKENTGV

SEQ ID NO: 252 - protein, 242 aa, Artificial Sequence
  MEMBRANE TYPE SERINE PROTEASE 1 (MT-SP1) protease domain I41R/F97T/ins97aE/T98G/F99L/C122S/G151D/Q175I/Q192 E
VVGGTDADEGEWPWQVSLHALGQGHRCGASLISPNWLVSAAHCYIDDRGFRYSDPTQWTAFLGLHDQSQRSAPGVQERRLKRIISHPFFNDTEGLDYDIALLELEKPAEYSSMVRPISLPDASHVFPAGKAIWVTGWGHTQYGGTDALILQKGEIRVINQTTCENLLPQIITPRMMCVGFLSGGVDSCEGDSGGPLSSVEADGRIFQAGVVSWGDGCAQRNKPGVYTRLPLFRDWIKENTGV

SEQ ID NO: 253 - protein, 242 aa, Artificial Sequence
  MEMBRANE TYPE SERINE PROTEASE 1 (MT-SP1) protease domain I41R/ins97aE/F97T/T98G/F99L/C122S/G151D/Q175I/Q192 D
VVGGTDADEGEWPWQVSLHALGQGHRCGASLISPNWLVSAAHCYIDDRGFRYSDPTQWTAFLGLHDQSQRSAPGVQERRLKRIISHPFFNDTEGLDYDIALLELEKPAEYSSMVRPISLPDASHVFPAGKAIWVTGWGHTQYGGTDALILQKGEIRVINQTTCENLLPQIITPRMMCVGFLSGGVDSCDGDSGGPLSSVEADGRIFQAGVVSWGDGCAQRNKPGVYTRLPLFRDWIKENTGV

SEQ ID NO: 254 - protein, 242 aa, Artificial Sequence
  MEMBRANE TYPE SERINE PROTEASE 1 (MT-SP1) protease domain S90T/D96A/ins97aE/F97T/T98G/F99L/C122S/Q175L/Q192D
VVGGTDADEGEWPWQVSLHALGQGHICGASLISPNWLVSAAHCYIDDRGFRYSDPTQWTAFLGLHDQSQRSAPGVQERRLKRIITHPFFNATEGLDYDIALLELEKPAEYSSMVRPISLPDASHVFPAGKAIWVTGWGHTQYGGTGALILQKGEIRVINQTTCENLLPQLITPRMMCVGFLSGGVDSCDGDSGGPLSSVEADGRIFQAGVVSWGDGCAQRNKPGVYTRLPLFRDWIKENTGV

SEQ ID NO: 255 - protein, 242 aa, Artificial Sequence
  MEMBRANE TYPE SERINE PROTEASE 1 (MT-SP1) protease domain Y59F/ins97aE/F97T/T98G/F99L/C122S/Q175L/Q192E
VVGGTDADEGEWPWQVSLHALGQGHICGASLISPNWLVSAAHCFIDDRGFRYSDPTQWTAFLGLHDQSQRSAPGVQERRLKRIISHPFFNDTEGLDYDIALLELEKPAEYSSMVRPISLPDASHVFPAGKAIWVTGWGHTQYGGTGALILQKGEIRVINQTTCENLLPQLITPRMMCVGFLSGGVDSCEGDSGGPLSSVEADGRIFQAGVVSWGDGCAQRNKPGVYTRLPLFRDWIKENTGV

SEQ ID NO: 256 - protein, 242 aa, Artificial Sequence
  MEMBRANE TYPE SERINE PROTEASE 1 (MT-SP1) protease domain ins97aE/F97T/T98G/F99L/C122S/Q175L/Q192E/Q209L
VVGGTDADEGEWPWQVSLHALGQGHICGASLISPNWLVSAAHCYIDDRGFRYSDPTQWTAFLGLHDQSQRSAPGVQERRLKRIISHPFFNDTEGLDYDIALLELEKPAEYSSMVRPISLPDASHVFPAGKAIWVTGWGHTQYGGTGALILQKGEIRVINQTTCENLLPQLITPRMMCVGFLSGGVDSCEGDSGGPLSSVEADGRIFLAGVVSWGDGCAQRNKPGVYTRLPLFRDWIKENTGV

SEQ ID NO: 257 - protein, 242 aa, Artificial Sequence
  MEMBRANE TYPE SERINE PROTEASE 1 (MT-SP1) protease domain Y59F/D96V/ins97aE/F97T/T98G/F99L/C122S/Q175L/Q192E
VVGGTDADEGEWPWQVSLHALGQGHICGASLISPNWLVSAAHCFIDDRGFRYSDPTQWTAFLGLHDQSQRSAPGVQERRLKRIISHPFFNVTEGLDYDIALLELEKPAEYSSMVRPISLPDASHVFPAGKAIWVTGWGHTQYGGTGALILQKGEIRVINQTTCENLLPQLITPRMMCVGFLSGGVDSCEGDSGGPLSSVEADGRIFQAGVVSWGDGCAQRNKPGVYTRLPLFRDWIKENTGV

SEQ ID NO: 258 - protein, 242 aa, Artificial Sequence
  MEMBRANE TYPE SERINE PROTEASE 1 (MT-SP1) protease domain D96V/ins97aE/F97T/T98G/F99L/C122S/Q175L/Q192D
VVGGTDADEGEWPWQVSLHALGQGHICGASLISPNWLVSAAHCYIDDRGFRYSDPTQWTAFLGLHDQSQRSAPGVQERRLKRIISHPFFNVTEGLDYDIALLELEKPAEYSSMVRPISLPDASHVFPAGKAIWVTGWGHTQYGGTGALILQKGEIRVINQTTCENLLPQLITPRMMCVGFLSGGVDSCDGDSGGPLSSVEADGRIFQAGVVSWGDGCAQRNKPGVYTRLPLFRDWIKENTGV

SEQ ID NO: 259 - protein, 242 aa, Artificial Sequence
  MEMBRANE TYPE SERINE PROTEASE 1 (MT-SP1) protease domain I41R/ins97aE/F97T/T98G/F99L/C122S/G151S/Q175L/Q192 E
VVGGTDADEGEWPWQVSLHALGQGHRCGASLISPNWLVSAAHCYIDDRGFRYSDPTQWTAFLGLHDQSQRSAPGVQERRLKRIISHPFFNDTEGLDYDIALLELEKPAEYSSMVRPISLPDASHVFPAGKAIWVTGWGHTQYGGTSALILQKGEIRVINQTTCENLLPQLITPRMMCVGFLSGGVDSCEGDSGGPLSSVEADGRIFQAGVVSWGDGCAQRNKPGVYTRLPLFRDWIKENTGV

SEQ ID NO: 260 - protein, 242 aa, Artificial Sequence
  MEMBRANE TYPE SERINE PROTEASE 1 (MT-SP1) protease domain E24K/ins97aE/F97T/T98G/F99L/C122S/A152S/Q175L/Q192 D
VVGGTDADKGEWPWQVSLHALGQGHICGASLISPNWLVSAAHCYIDDRGFRYSDPTQWTAFLGLHDQSQRSAPGVQERRLKRIISHPFFNDTEGLDYDIALLELEKPAEYSSMVRPISLPDASHVFPAGKAIWVTGWGHTQYGGTGSLILQKGEIRVINQTTCENLLPQLITPRMMCVGFLSGGVDSCDGDSGGPLSSVEADGRIFQAGVVSWGDGCAQRNKPGVYTRLPLFRDWIKENTGV

SEQ ID NO: 261 - protein, 242 aa, Artificial Sequence
  MEMBRANE TYPE SERINE PROTEASE 1 (MT-SP1) protease domain ins97aE/F97T/T98G/F99L/C122S/L153Q/Q175L/Q192D
VVGGTDADEGEWPWQVSLHALGQGHICGASLISPNWLVSAAHCYIDDRGFRYSDPTQWTAFLGLHDQSQRSAPGVQERRLKRIISHPFFNDTEGLDYDIALLELEKPAEYSSMVRPISLPDASHVFPAGKAIWVTGWGHTQYGGTGAQILQKGEIRVINQTTCENLLPQLITPRMMCVGFLSGGVDSCDGDSGGPLSSVEADGRIFQAGVVSWGDGCAQRNKPGVYTRLPLFRDWIKENTGV

SEQ ID NO: 262 - protein, 242 aa, Artificial Sequence
  MEMBRANE TYPE SERINE PROTEASE 1 (MT-SP1) protease domain ins97aE/F97T/T98G/F99L/C122S/I136M/L155M/N170D/Q17 5L/Q192E
VVGGTDADEGEWPWQVSLHALGQGHICGASLISPNWLVSAAHCYIDDRGFRYSDPTQWTAFLGLHDQSQRSAPGVQERRLKRIISHPFFNDTEGLDYDIALLELEKPAEYSSMVRPISLPDASHVFPAGKAMWVTGWGHTQYGGTGALIMQKGEIRVINQTTCEDLLPQLITPRMMCVGFLSGGVDSCEGDSGGPLSSVEADGRIFQAGVVSWGDGCAQRNKPGVYTRLPLFRDWIKENTGV

SEQ ID NO: 263 - protein, 242 aa, Artificial Sequence
  MEMBRANE TYPE SERINE PROTEASE 1 (MT-SP1) protease domain I41R/ins97aE/F97T/T98G/F99L/A112V/C122S/Q175L/Q192 E
VVGGTDADEGEWPWQVSLHALGQGHRCGASLISPNWLVSAAHCYIDDRGFRYSDPTQWTAFLGLHDQSQRSAPGVQERRLKRIISHPFFNDTEGLDYDIALLELEKPVEYSSMVRPISLPDASHVFPAGKAIWVTGWGHTQYGGTGALILQKGEIRVINQTTCENLLPQLITPRMMCVGFLSGGVDSCEGDSGGPLSSVEADGRIFQAGVVSWGDGCAQRNKPGVYTRLPLFRDWIKENTGV

SEQ ID NO: 264 - protein, 242 aa, Artificial Sequence
  MEMBRANE TYPE SERINE PROTEASE 1 (MT-SP1) protease domain Y59F/F97T/ins97aE/T98G/F99L/C122S/Q175L/Q192D
VVGGTDADEGEWPWQVSLHALGQGHICGASLISPNWLVSAAHCFIDDRGFRYSDPTQWTAFLGLHDQSQRSAPGVQERRLKRIISHPFFNDTEGLDYDIALLELEKPAEYSSMVRPISLPDASHVFPAGKAIWVTGWGHTQYGGTGALILQKGEIRVINQTTCENLLPQLITPRMMCVGFLSGGVDSCDGDSGGPLSSVEADGRIFQAGVVSWGDGCAQRNKPGVYTRLPLFRDWIKENTGV

SEQ ID NO: 265 - protein, 242 aa, Artificial Sequence
  MEMBRANE TYPE SERINE PROTEASE 1 (MT-SP1) protease domain Y59F/G60dS/R84H/ins97aE/F97T/T98G/F99L/C122S/Q175L /Q192E/V212I
VVGGTDADEGEWPWQVSLHALGQGHICGASLISPNWLVSAAHCFIDDRSFRYSDPTQWTAFLGLHDQSQRSAPGVQERHLKRIISHPFFNDTEGLDYDIALLELEKPAEYSSMVRPISLPDASHVFPAGKAIWVTGWGHTQYGGTGALILQKGEIRVINQTTCENLLPQLITPRMMCVGFLSGGVDSCEGDSGGPLSSVEADGRIFQAGIVSWGDGCAQRNKPGVYTRLPLFRDWIKENTGV

SEQ ID NO: 266 - protein, 242 aa, Artificial Sequence
  MEMBRANE TYPE SERINE PROTEASE 1 (MT-SP1) protease domain Y59F/ins97aE/F97T/T98G/F99L/C122S/L153Q/Q175L/Q192 E
VVGGTDADEGEWPWQVSLHALGQGHICGASLISPNWLVSAAHCFIDDRGFRYSDPTQWTAFLGLHDQSQRSAPGVQERRLKRIISHPFFNDTEGLDYDIALLELEKPAEYSSMVRPISLPDASHVFPAGKAIWVTGWGHTQYGGTGAQILQKGEIRVINQTTCENLLPQLITPRMMCVGFLSGGVDSCEGDSGGPLSSVEADGRIFQAGVVSWGDGCAQRNKPGVYTRLPLFRDWIKENTGV

SEQ ID NO: 267 - protein, 242 aa, Artificial Sequence
  MEMBRANE TYPE SERINE PROTEASE 1 (MT-SP1) protease domain I41R/Y59F/ins97aE/F97T/T98G/F99L/C122S/Q175L/Q192D
VVGGTDADEGEWPWQVSLHALGQGHRCGASLISPNWLVSAAHCFIDDRGFRYSDPTQWTAFLGLHDQSQRSAPGVQERRLKRIISHPFFNDTEGLDYDIALLELEKPAEYSSMVRPISLPDASHVFPAGKAIWVTGWGHTQYGGTGALILQKGEIRVINQTTCENLLPQLITPRMMCVGFLSGGVDSCDGDSGGPLSSVEADGRIFQAGVVSWGDGCAQRNKPGVYTRLPLFRDWIKENTGV

SEQ ID NO: 268 - protein, 242 aa, Artificial Sequence
  MEMBRANE TYPE SERINE PROTEASE 1 (MT-SP1) protease domain I41R/Y59F/G60dS/R84H/ins97aE/F97T/T98G/F99L/C122S/ Q175L/Q192E/V212I
VVGGTDADEGEWPWQVSLHALGQGHRCGASLISPNWLVSAAHCFIDDRSFRYSDPTQWTAFLGLHDQSQRSAPGVQERHLKRIISHPFFNDTEGLDYDIALLELEKPAEYSSMVRPISLPDASHVFPAGKAIWVTGWGHTQYGGTGALILQKGEIRVINQTTCENLLPQLITPRMMCVGFLSGGVDSCEGDSGGPLSSVEADGRIFQAGIVSWGDGCAQRNKPGVYTRLPLFRDWIKENTGV

SEQ ID NO: 269 - protein, 242 aa, Artificial Sequence
  MEMBRANE TYPE SERINE PROTEASE 1 (MT-SP1) protease domain I41R/Y59F/ins97aE/F97T/T98G/F99L/C122S/L153Q/Q175L /Q192E
VVGGTDADEGEWPWQVSLHALGQGHRCGASLISPNWLVSAAHCFIDDRGFRYSDPTQWTAFLGLHDQSQRSAPGVQERRLKRIISHPFFNDTEGLDYDIALLELEKPAEYSSMVRPISLPDASHVFPAGKAIWVTGWGHTQYGGTGAQILQKGEIRVINQTTCENLLPQLITPRMMCVGFLSGGVDSCEGDSGGPLSSVEADGRIFQAGVVSWGDGCAQRNKPGVYTRLPLFRDWIKENTGV

SEQ ID NO: 270 - protein, 241 aa, Artificial Sequence
  MEMBRANE TYPE SERINE PROTEASE 1 (MT-SP1) protease domain I41R/F97W/F99L/C122S/G151N/Q192G
VVGGTDADEGEWPWQVSLHALGQGHRCGASLISPNWLVSAAHCYIDDRGFRYSDPTQWTAFLGLHDQSQRSAPGVQERRLKRIISHPFFNDWTLDYDIALLELEKPAEYSSMVRPISLPDASHVFPAGKAIWVTGWGHTQYGGTNALILQKGEIRVINQTTCENLLPQQITPRMMCVGFLSGGVDSCGGDSGGPLSSVEADGRIFQAGVVSWGDGCAQRNKPGVYTRLPLFRDWIKENTGV

SEQ ID NO: 271 - protein, 242 aa, Artificial Sequence
  MEMBRANE TYPE SERINE PROTEASE 1 (MT-SP1) protease domain F97D/ins97aV/T98P/F99L/C122S/G151N/Q192G
VVGGTDADEGEWPWQVSLHALGQGHICGASLISPNWLVSAAHCYIDDRGFRYSDPTQWTAFLGLHDQSQRSAPGVQERRLKRIISHPFFNDDVPLDYDIALLELEKPAEYSSMVRPISLPDASHVFPAGKAIWVTGWGHTQYGGTNALILQKGEIRVINQTTCENLLPQQITPRMMCVGFLSGGVDSCGGDSGGPLSSVEADGRIFQAGVVSWGDGCAQRNKPGVYTRLPLFRDWIKENTGV

SEQ ID NO: 272 - protein, 242 aa, Artificial Sequence
  MEMBRANE TYPE SERINE PROTEASE 1 (MT-SP1) protease domain I41D/ins97aE/F97T/T98G/F99L/C122S/Q175L/Q192E
VVGGTDADEGEWPWQVSLHALGQGHDCGASLISPNWLVSAAHCYIDDRGFRYSDPTQWTAFLGLHDQSQRSAPGVQERRLKRIISHPFFNDTEGLDYDIALLELEKPAEYSSMVRPISLPDASHVFPAGKAIWVTGWGHTQYGGTGALILQKGEIRVINQTTCENLLPQLITPRMMCVGFLSGGVDSCEGDSGGPLSSVEADGRIFQAGVVSWGDGCAQRNKPGVYTRLPLFRDWIKENTGV

SEQ ID NO: 273 - protein, 242 aa, Artificial Sequence
  MEMBRANE TYPE SERINE PROTEASE 1 (MT-SP1) protease domain I41D/ins97aE/F97T/T98G/F99L/C122S/G151N/Q175L/Q192 E
VVGGTDADEGEWPWQVSLHALGQGHDCGASLISPNWLVSAAHCYIDDRGFRYSDPTQWTAFLGLHDQSQRSAPGVQERRLKRIISHPFFNDTEGLDYDIALLELEKPAEYSSMVRPISLPDASHVFPAGKAIWVTGWGHTQYGGTNALILQKGEIRVINQTTCENLLPQLITPRMMCVGFLSGGVDSCEGDSGGPLSSVEADGRIFQAGVVSWGDGCAQRNKPGVYTRLPLFRDWIKENTGV

SEQ ID NO: 274 - protein, 241 aa, Artificial Sequence
  MEMBRANE TYPE SERINE PROTEASE 1 (MT-SP1) protease domain Q38E/H40R/I41H/F97D/F99L/C122S/Q192G
VVGGTDADEGEWPWQVSLHALGEGRHCGASLISPNWLVSAAHCYIDDRGFRYSDPTQWTAFLGLHDQSQRSAPGVQERRLKRIISHPFFNDDTLDYDIALLELEKPAEYSSMVRPISLPDASHVFPAGKAIWVTGWGHTQYGGTGALILQKGEIRVINQTTCENLLPQQITPRMMCVGFLSGGVDSCGGDSGGPLSSVEADGRIFQAGVVSWGDGCAQRNKPGVYTRLPLFRDWIKENTGV

SEQ ID NO: 275 - protein, 241 aa, Artificial Sequence
  MEMBRANE TYPE SERINE PROTEASE 1 (MT-SP1) protease domain H40R/I41H/F97D/F99L/Q175R/Q192G/D217E/K224R
VVGGTDADEGEWPWQVSLHALGQGRHCGASLISPNWLVSAAHCYIDDRGFRYSDPTQWTAFLGLHDQSQRSAPGVQERRLKRIISHPFFNDDTLDYDIALLELEKPAEYSSMVRPICLPDASHVFPAGKAIWVTGWGHTQYGGTGALILQKGEIRVINQTTCENLLPQRITPRMMCVGFLSGGVDSCGGDSGGPLSSVEADGRIFQAGVVSWGEGCAQRNRPGVYTRLPLFRDWIKENTGV

SEQ ID NO: 276 - protein, 242 aa, Artificial Sequence
  MEMBRANE TYPE SERINE PROTEASE 1 (MT-SP1) protease domain I41R/ins97aV/F97D/T98P/F99L/C122S/G151N/Q192G
VVGGTDADEGEWPWQVSLHALGQGHRCGASLISPNWLVSAAHCYIDDRGFRYSDPTQWTAFLGLHDQSQRSAPGVQERRLKRIISHPFFNDDVPLDYDIALLELEKPAEYSSMVRPISLPDASHVFPAGKAIWVTGWGHTQYGGTNALILQKGEIRVINQTTCENLLPQQITPRMMCVGFLSGGVDSCGGDSGGPLSSVEADGRIFQAGVVSWGDGCAQRNKPGVYTRLPLFRDWIKENTGV

SEQ ID NO: 277 - protein, 242 aa, Artificial Sequence
  MEMBRANE TYPE SERINE PROTEASE 1 (MT-SP1) protease domain ins97aV/F97D/T98P/F99L/C122S/Q175L/Q192E
VVGGTDADEGEWPWQVSLHALGQGHICGASLISPNWLVSAAHCYIDDRGFRYSDPTQWTAFLGLHDQSQRSAPGVQERRLKRIISHPFFNDDVPLDYDIALLELEKPAEYSSMVRPISLPDASHVFPAGKAIWVTGWGHTQYGGTGALILQKGEIRVINQTTCENLLPQLITPRMMCVGFLSGGVDSCEGDSGGPLSSVEADGRIFQAGVVSWGDGCAQRNKPGVYTRLPLFRDWIKENTGV

SEQ ID NO: 278 - protein, 242 aa, Artificial Sequence
  MEMBRANE TYPE SERINE PROTEASE 1 (MT-SP1) protease domain I41R/ins97aV/F97D/T98P/F99L/C122S/G151N/Q175L/Q192 E
VVGGTDADEGEWPWQVSLHALGQGHRCGASLISPNWLVSAAHCYIDDRGFRYSDPTQWTAFLGLHDQSQRSAPGVQERRLKRIISHPFFNDDVPLDYDIALLELEKPAEYSSMVRPISLPDASHVFPAGKAIWVTGWGHTQYGGTNALILQKGEIRVINQTTCENLLPQLITPRMMCVGFLSGGVDSCEGDSGGPLSSVEADGRIFQAGVVSWGDGCAQRNKPGVYTRLPLFRDWIKENTGV

SEQ ID NO: 279 - protein, 241 aa, Artificial Sequence
  MEMBRANE TYPE SERINE PROTEASE 1 (MT-SP1) protease domain Q38E/H40R/I41H/D60bE/F97D/F99L/C122S/Q192G
VVGGTDADEGEWPWQVSLHALGEGRHCGASLISPNWLVSAAHCYIDERGFRYSDPTQWTAFLGLHDQSQRSAPGVQERRLKRIISHPFFNDDTLDYDIALLELEKPAEYSSMVRPISLPDASHVFPAGKAIWVTGWGHTQYGGTGALILQKGEIRVINQTTCENLLPQQITPRMMCVGFLSGGVDSCGGDSGGPLSSVEADGRIFQAGVVSWGDGCAQRNKPGVYTRLPLFRDWIKENTGV

SEQ ID NO: 280 - protein, 241 aa, Artificial Sequence
  MEMBRANE TYPE SERINE PROTEASE 1 (MT-SP1) protease domain Q38E/H40R/I41H/D60bN/F97D/F99L/C122S/Q192G
VVGGTDADEGEWPWQVSLHALGEGRHCGASLISPNWLVSAAHCYIDNRGFRYSDPTQWTAFLGLHDQSQRSAPGVQERRLKRIISHPFFNDDTLDYDIALLELEKPAEYSSMVRPISLPDASHVFPAGKAIWVTGWGHTQYGGTGALILQKGEIRVINQTTCENLLPQQITPRMMCVGFLSGGVDSCGGDSGGPLSSVEADGRIFQAGVVSWGDGCAQRNKPGVYTRLPLFRDWIKENTGV

SEQ ID NO: 281 - protein, 241 aa, Artificial Sequence
  MEMBRANE TYPE SERINE PROTEASE 1 (MT-SP1) protease domain Q38E/H40R/I41H/D60bK/F97D/F99L/C122S/Q175L/Q192G
VVGGTDADEGEWPWQVSLHALGEGRHCGASLISPNWLVSAAHCYIDKRGFRYSDPTQWTAFLGLHDQSQRSAPGVQERRLKRIISHPFFNDDTLDYDIALLELEKPAEYSSMVRPISLPDASHVFPAGKAIWVTGWGHTQYGGTGALILQKGEIRVINQTTCENLLPQLITPRMMCVGFLSGGVDSCGGDSGGPLSSVEADGRIFQAGVVSWGDGCAQRNKPGVYTRLPLFRDWIKENTGV

SEQ ID NO: 282 - protein, 241 aa, Artificial Sequence
  MEMBRANE TYPE SERINE PROTEASE 1 (MT-SP1) protease domain Q38E/H40R/I41H/D60bN/F60eT/F97D/F99L/C122S/Q175L/Q 192G
VVGGTDADEGEWPWQVSLHALGEGRHCGASLISPNWLVSAAHCYIDNRGTRYSDPTQWTAFLGLHDQSQRSAPGVQERRLKRIISHPFFNDDTLDYDIALLELEKPAEYSSMVRPISLPDASHVFPAGKAIWVTGWGHTQYGGTGALILQKGEIRVINQTTCENLLPQLITPRMMCVGFLSGGVDSCGGDSGGPLSSVEADGRIFQAGVVSWGDGCAQRNKPGVYTRLPLFRDWIKENTGV

SEQ ID NO: 283 - protein, 242 aa, Artificial Sequence
  MEMBRANE TYPE SERINE PROTEASE 1 (MT-SP1) protease domain Q38R/I41S/D60bH/F60eV/F97T/ins97aE/T98G/F99L/C122S /Q175L/Q192E
VVGGTDADEGEWPWQVSLHALGRGHSCGASLISPNWLVSAAHCYIDHRGVRYSDPTQWTAFLGLHDQSQRSAPGVQERRLKRIISHPFFNDTEGLDYDIALLELEKPAEYSSMVRPISLPDASHVFPAGKAIWVTGWGHTQYGGTGALILQKGEIRVINQTTCENLLPQLITPRMMCVGFLSGGVDSCEGDSGGPLSSVEADGRIFQAGVVSWGDGCAQRNKPGVYTRLPLFRDWIKENTGV

SEQ ID NO: 284 - protein, 241 aa, Artificial Sequence
  MEMBRANE TYPE SERINE PROTEASE 1 (MT-SP1) protease domain Q38G/H40R/I41H/D60bK/F97D/F99L/C122S/Q175L/Q192G
VVGGTDADEGEWPWQVSLHALGGGRHCGASLISPNWLVSAAHCYIDKRGFRYSDPTQWTAFLGLHDQSQRSAPGVQERRLKRIISHPFFNDDTLDYDIALLELEKPAEYSSMVRPISLPDASHVFPAGKAIWVTGWGHTQYGGTGALILQKGEIRVINQTTCENLLPQLITPRMMCVGFLSGGVDSCGGDSGGPLSSVEADGRIFQAGVVSWGDGCAQRNKPGVYTRLPLFRDWIKENTGV

SEQ ID NO: 285 - protein, 242 aa, Artificial Sequence
  MEMBRANE TYPE SERINE PROTEASE 1 (MT-SP1) protease domain I41D/ins97aE/F97T/T98G/F99L/C122S/G151N/Q175L/Q192 E/Q209L
VVGGTDADEGEWPWQVSLHALGQGHDCGASLISPNWLVSAAHCYIDDRGFRYSDPTQWTAFLGLHDQSQRSAPGVQERRLKRIISHPFFNDTEGLDYDIALLELEKPAEYSSMVRPISLPDASHVFPAGKAIWVTGWGHTQYGGTNALILQKGEIRVINQTTCENLLPQLITPRMMCVGFLSGGVDSCEGDSGGPLSSVEADGRIFLAGVVSWGDGCAQRNKPGVYTRLPLFRDWIKENTGV

SEQ ID NO: 286 - protein, 241 aa, Artificial Sequence
  MEMBRANE TYPE SERINE PROTEASE 1 (MT-SP1) protease domain Q38G/H40R/I41H/D60bN/F97D/F99L/C122S/Q175L/Q192G
VVGGTDADEGEWPWQVSLHALGGGRHCGASLISPNWLVSAAHCYIDNRGFRYSDPTQWTAFLGLHDQSQRSAPGVQERRLKRIISHPFFNDDTLDYDIALLELEKPAEYSSMVRPISLPDASHVFPAGKAIWVTGWGHTQYGGTGALILQKGEIRVINQTTCENLLPQLITPRMMCVGFLSGGVDSCGGDSGGPLSSVEADGRIFQAGVVSWGDGCAQRNKPGVYTRLPLFRDWIKENTGV

SEQ ID NO: 287 - protein, 242 aa, Artificial Sequence
  MEMBRANE TYPE SERINE PROTEASE 1 (MT-SP1) protease domain Q38R/I41S/D60bH/F60eV/ins97aE/F97T/T98G/F99L/C122S /G151N/Q175L/Q192E
VVGGTDADEGEWPWQVSLHALGRGHSCGASLISPNWLVSAAHCYIDHRGVRYSDPTQWTAFLGLHDQSQRSAPGVQERRLKRIISHPFFNDTEGLDYDIALLELEKPAEYSSMVRPISLPDASHVFPAGKAIWVTGWGHTQYGGTNALILQKGEIRVINQTTCENLLPQLITPRMMCVGFLSGGVDSCEGDSGGPLSSVEADGRIFQAGVVSWGDGCAQRNKPGVYTRLPLFRDWIKENTGV

SEQ ID NO: 288 - protein, 242 aa, Artificial Sequence
  MEMBRANE TYPE SERINE PROTEASE 1 (MT-SP1) protease domain H40R/I41H/F97D/ins97aV/T98P/F99L/C122S/Q175R/Q192G /D217E/K224R
VVGGTDADEGEWPWQVSLHALGQGRHCGASLISPNWLVSAAHCYIDDRGFRYSDPTQWTAFLGLHDQSQRSAPGVQERRLKRIISHPFFNDDVPLDYDIALLELEKPAEYSSMVRPISLPDASHVFPAGKAIWVTGWGHTQYGGTGALILQKGEIRVINQTTCENLLPQRITPRMMCVGFLSGGVDSCGGDSGGPLSSVEADGRIFQAGVVSWGEGCAQRNRPGVYTRLPLFRDWIKENTGV

SEQ ID NO: 289 - protein, 242 aa, Artificial Sequence
  MEMBRANE TYPE SERINE PROTEASE 1 (MT-SP1) protease domain Q38H/I41S/D60bA/F60eV/Y60gF/F97T/ins97aE/T98G/F99L /C122S/Q175L/Q192T
VVGGTDADEGEWPWQVSLHALGHGHSCGASLISPNWLVSAAHCYIDARGVRFSDPTQWTAFLGLHDQSQRSAPGVQERRLKRIISHPFFNDTEGLDYDIALLELEKPAEYSSMVRPISLPDASHVFPAGKAIWVTGWGHTQYGGTGALILQKGEIRVINQTTCENLLPQLITPRMMCVGFLSGGVDSCTGDSGGPLSSVEADGRIFQAGVVSWGDGCAQRNKPGVYTRLPLFRDWIKENTGV

SEQ ID NO: 290 - protein, 242 aa, Artificial Sequence
  MEMBRANE TYPE SERINE PROTEASE 1 (MT-SP1) protease domain Q38E/I41S/D60bH/F60eI/F97T/ins97aE/T98G/F99L/C122S /Q175L/Q192V
VVGGTDADEGEWPWQVSLHALGEGHSCGASLISPNWLVSAAHCYIDHRGIRYSDPTQWTAFLGLHDQSQRSAPGVQERRLKRIISHPFFNDTEGLDYDIALLELEKPAEYSSMVRPISLPDASHVFPAGKAIWVTGWGHTQYGGTGALILQKGEIRVINQTTCENLLPQLITPRMMCVGFLSGGVDSCVGDSGGPLSSVEADGRIFQAGVVSWGDGCAQRNKPGVYTRLPLFRDWIKENTGV

SEQ ID NO: 291 - protein, 242 aa, Artificial Sequence
  MEMBRANE TYPE SERINE PROTEASE 1 (MT-SP1) protease domain Q38R/I41S/D60bH/F60eI/ins97aE/F97T/T98G/F99L/C122S /Q175L/Q192E
VVGGTDADEGEWPWQVSLHALGRGHSCGASLISPNWLVSAAHCYIDHRGIRYSDPTQWTAFLGLHDQSQRSAPGVQERRLKRIISHPFFNDTEGLDYDIALLELEKPAEYSSMVRPISLPDASHVFPAGKAIWVTGWGHTQYGGTGALILQKGEIRVINQTTCENLLPQLITPRMMCVGFLSGGVDSCEGDSGGPLSSVEADGRIFQAGVVSWGDGCAQRNKPGVYTRLPLFRDWIKENTGV

SEQ ID NO: 292 - protein, 242 aa, Artificial Sequence
  MEMBRANE TYPE SERINE PROTEASE 1 (MT-SP1) protease domain Q38E/I41S/D60bV/F60eK/F97T/ins97aE/T98G/F99L/C122S /Q175L/Q192I
VVGGTDADEGEWPWQVSLHALGEGHSCGASLISPNWLVSAAHCYIDVRGKRYSDPTQWTAFLGLHDQSQRSAPGVQERRLKRIISHPFFNDTEGLDYDIALLELEKPAEYSSMVRPISLPDASHVFPAGKAIWVTGWGHTQYGGTGALILQKGEIRVINQTTCENLLPQLITPRMMCVGFLSGGVDSCIGDSGGPLSSVEADGRIFQAGVVSWGDGCAQRNKPGVYTRLPLFRDWIKENTGV

SEQ ID NO: 293 - protein, 242 aa, Artificial Sequence
  MEMBRANE TYPE SERINE PROTEASE 1 (MT-SP1) protease domain Q38R/I41E/ins97aE/F97T/T98G/F99L/C122S/Q175L/Q192T
VVGGTDADEGEWPWQVSLHALGRGHECGASLISPNWLVSAAHCYIDDRGFRYSDPTQWTAFLGLHDQSQRSAPGVQERRLKRIISHPFFNDTEGLDYDIALLELEKPAEYSSMVRPISLPDASHVFPAGKAIWVTGWGHTQYGGTGALILQKGEIRVINQTTCENLLPQLITPRMMCVGFLSGGVDSCTGDSGGPLSSVEADGRIFQAGVVSWGDGCAQRNKPGVYTRLPLFRDWIKENTGV

SEQ ID NO: 294 - protein, 242 aa, Artificial Sequence
  MEMBRANE TYPE SERINE PROTEASE 1 (MT-SP1) protease domain Q38H/I41A/D60bV/F60eR/Y60gW/ins97aE/F97T/T98G/F99L /C122S/Q175L/Q192D
VVGGTDADEGEWPWQVSLHALGHGHACGASLISPNWLVSAAHCYIDVRGRRWSDPTQWTAFLGLHDQSQRSAPGVQERRLKRIISHPFFNDTEGLDYDIALLELEKPAEYSSMVRPISLPDASHVFPAGKAIWVTGWGHTQYGGTGALILQKGEIRVINQTTCENLLPQLITPRMMCVGFLSGGVDSCDGDSGGPLSSVEADGRIFQAGVVSWGDGCAQRNKPGVYTRLPLFRDWIKENTGV

SEQ ID NO: 295 - protein, 242 aa, Artificial Sequence
  MEMBRANE TYPE SERINE PROTEASE 1 (MT-SP1) protease domain Q38H/I41A/D60bA/F60eR/F97T/ins97aE/T98G/F99L/C122S /Q175L/Q192E
VVGGTDADEGEWPWQVSLHALGHGHACGASLISPNWLVSAAHCYIDARGRRYSDPTQWTAFLGLHDQSQRSAPGVQERRLKRIISHPFFNDTEGLDYDIALLELEKPAEYSSMVRPISLPDASHVFPAGKAIWVTGWGHTQYGGTGALILQKGEIRVINQTTCENLLPQLITPRMMCVGFLSGGVDSCEGDSGGPLSSVEADGRIFQAGVVSWGDGCAQRNKPGVYTRLPLFRDWIKENTGV

SEQ ID NO: 296 - protein, 242 aa, Artificial Sequence
  MEMBRANE TYPE SERINE PROTEASE 1 (MT-SP1) protease domain F97D/ins97aV/T98P/F99L/C122S/G151N/Q175L/Q192E
VVGGTDADEGEWPWQVSLHALGQGHICGASLISPNWLVSAAHCYIDDRGFRYSDPTQWTAFLGLHDQSQRSAPGVQERRLKRIISHPFFNDDVPLDYDIALLELEKPAEYSSMVRPISLPDASHVFPAGKAIWVTGWGHTQYGGTNALILQKGEIRVINQTTCENLLPQLITPRMMCVGFLSGGVDSCEGDSGGPLSSVEADGRIFQAGVVSWGDGCAQRNKPGVYTRLPLFRDWIKENTGV

SEQ ID NO: 297 - protein, 242 aa, Artificial Sequence
  MEMBRANE TYPE SERINE PROTEASE 1 (MT-SP1) protease domain ins97aV/F97D/T98P/F99L/C122S/G151N/Q175L/Q192G
VVGGTDADEGEWPWQVSLHALGQGHICGASLISPNWLVSAAHCYIDDRGFRYSDPTQWTAFLGLHDQSQRSAPGVQERRLKRIISHPFFNDDVPLDYDIALLELEKPAEYSSMVRPISLPDASHVFPAGKAIWVTGWGHTQYGGTNALILQKGEIRVINQTTCENLLPQLITPRMMCVGFLSGGVDSCGGDSGGPLSSVEADGRIFQAGVVSWGDGCAQRNKPGVYTRLPLFRDWIKENTGV

SEQ ID NO: 298 - protein, 241 aa, Artificial Sequence
  MEMBRANE TYPE SERINE PROTEASE 1 (MT-SP1) protease domain Q38G/H40R/I41H/D60bN/F60eT/F97D/F99L/C122S/Q175L/Q 192G
VVGGTDADEGEWPWQVSLHALGGGRHCGASLISPNWLVSAAHCYIDNRGTRYSDPTQWTAFLGLHDQSQRSAPGVQERRLKRIISHPFFNDDTLDYDIALLELEKPAEYSSMVRPISLPDASHVFPAGKAIWVTGWGHTQYGGTGALILQKGEIRVINQTTCENLLPQLITPRMMCVGFLSGGVDSCGGDSGGPLSSVEADGRIFQAGVVSWGDGCAQRNKPGVYTRLPLFRDWIKENTGV

SEQ ID NO: 299 - protein, 241 aa, Artificial Sequence
  MEMBRANE TYPE SERINE PROTEASE 1 (MT-SP1) protease domain Q38G/H40R/I41H/D60bK/F60eT/F97D/F99L/C122S/Q175L/Q 192G
VVGGTDADEGEWPWQVSLHALGGGRHCGASLISPNWLVSAAHCYIDKRGTRYSDPTQWTAFLGLHDQSQRSAPGVQERRLKRIISHPFFNDDTLDYDIALLELEKPAEYSSMVRPISLPDASHVFPAGKAIWVTGWGHTQYGGTGALILQKGEIRVINQTTCENLLPQLITPRMMCVGFLSGGVDSCGGDSGGPLSSVEADGRIFQAGVVSWGDGCAQRNKPGVYTRLPLFRDWIKENTGV

SEQ ID NO: 300 - protein, 241 aa, Artificial Sequence
  MEMBRANE TYPE SERINE PROTEASE 1 (MT-SP1) protease domain Q38E/H40R/I41H/D60bK/F60eT/F97D/F99L/C122S/Q175L/Q 192G
VVGGTDADEGEWPWQVSLHALGEGRHCGASLISPNWLVSAAHCYIDKRGTRYSDPTQWTAFLGLHDQSQRSAPGVQERRLKRIISHPFFNDDTLDYDIALLELEKPAEYSSMVRPISLPDASHVFPAGKAIWVTGWGHTQYGGTGALILQKGEIRVINQTTCENLLPQLITPRMMCVGFLSGGVDSCGGDSGGPLSSVEADGRIFQAGVVSWGDGCAQRNKPGVYTRLPLFRDWIKENTGV

SEQ ID NO: 301 - protein, 242 aa, Artificial Sequence
  MEMBRANE TYPE SERINE PROTEASE 1 (MT-SP1) protease domain Q38H/I41S/D60bA/F60eV/Y60gF/ins97aE/F97T/T98G/F99L /C122S/G151N/Q175L/Q192T
VVGGTDADEGEWPWQVSLHALGHGHSCGASLISPNWLVSAAHCYIDARGVRFSDPTQWTAFLGLHDQSQRSAPGVQERRLKRIISHPFFNDTEGLDYDIALLELEKPAEYSSMVRPISLPDASHVFPAGKAIWVTGWGHTQYGGTNALILQKGEIRVINQTTCENLLPQLITPRMMCVGFLSGGVDSCTGDSGGPLSSVEADGRIFQAGVVSWGDGCAQRNKPGVYTRLPLFRDWIKENTGV

SEQ ID NO: 302 - protein, 242 aa, Artificial Sequence
  MEMBRANE TYPE SERINE PROTEASE 1 (MT-SP1) protease domain Q38E/I41S/D60bH/F60eI/ins97aE/F97T/T98G/F99L/C122S /G151N/Q175L/Q192V
VVGGTDADEGEWPWQVSLHALGEGHSCGASLISPNWLVSAAHCYIDHRGIRYSDPTQWTAFLGLHDQSQRSAPGVQERRLKRIISHPFFNDTEGLDYDIALLELEKPAEYSSMVRPISLPDASHVFPAGKAIWVTGWGHTQYGGTNALILQKGEIRVINQTTCENLLPQLITPRMMCVGFLSGGVDSCVGDSGGPLSSVEADGRIFQAGVVSWGDGCAQRNKPGVYTRLPLFRDWIKENTGV

SEQ ID NO: 303 - protein, 242 aa, Artificial Sequence
  MEMBRANE TYPE SERINE PROTEASE 1 (MT-SP1) protease domain Q38R/I41S/D60bH/F60eI/ins97aE/F97T/T98G/F99L/C122S /G151N/Q175L/Q192E
VVGGTDADEGEWPWQVSLHALGRGHSCGASLISPNWLVSAAHCYIDHRGIRYSDPTQWTAFLGLHDQSQRSAPGVQERRLKRIISHPFFNDTEGLDYDIALLELEKPAEYSSMVRPISLPDASHVFPAGKAIWVTGWGHTQYGGTNALILQKGEIRVINQTTCENLLPQLITPRMMCVGFLSGGVDSCEGDSGGPLSSVEADGRIFQAGVVSWGDGCAQRNKPGVYTRLPLFRDWIKENTGV

SEQ ID NO: 304 - protein, 242 aa, Artificial Sequence
  MEMBRANE TYPE SERINE PROTEASE 1 (MT-SP1) protease domain Q38E/I41S/D60bV/F60eK/ins97aE/F97T/T98G/F99L/C122S /G151N/Q175L/Q192I
VVGGTDADEGEWPWQVSLHALGEGHSCGASLISPNWLVSAAHCYIDVRGKRYSDPTQWTAFLGLHDQSQRSAPGVQERRLKRIISHPFFNDTEGLDYDIALLELEKPAEYSSMVRPISLPDASHVFPAGKAIWVTGWGHTQYGGTNALILQKGEIRVINQTTCENLLPQLITPRMMCVGFLSGGVDSCIGDSGGPLSSVEADGRIFQAGVVSWGDGCAQRNKPGVYTRLPLFRDWIKENTGV

SEQ ID NO: 305 - protein, 242 aa, Artificial Sequence
  MEMBRANE TYPE SERINE PROTEASE 1 (MT-SP1) protease domain Q38R/I41E/ins97aE/F97T/T98G/F99L/C122S/G151N/Q175L /Q192T
VVGGTDADEGEWPWQVSLHALGRGHECGASLISPNWLVSAAHCYIDDRGFRYSDPTQWTAFLGLHDQSQRSAPGVQERRLKRIISHPFFNDTEGLDYDIALLELEKPAEYSSMVRPISLPDASHVFPAGKAIWVTGWGHTQYGGTNALILQKGEIRVINQTTCENLLPQLITPRMMCVGFLSGGVDSCTGDSGGPLSSVEADGRIFQAGVVSWGDGCAQRNKPGVYTRLPLFRDWIKENTGV

SEQ ID NO: 306 - protein, 242 aa, Artificial Sequence; identical to SEQ ID NO: 22
  MEMBRANE TYPE SERINE PROTEASE 1 (MT-SP1) protease domain Q38H/I41A/D60bV/F60eR/Y60gW/ins97aE/F97T/T98G/F99L /C122S/G151N/Q175L/Q192D

SEQ ID NO: 307 - protein, 242 aa, Artificial Sequence
  MEMBRANE TYPE SERINE PROTEASE 1 (MT-SP1) protease domain Q38H/I41A/D60bA/F60eR/ins97aE/F97T/T98G/F99L/C122S /G151N/Q175L/Q192E
VVGGTDADEGEWPWQVSLHALGHGHACGASLISPNWLVSAAHCYIDARGRRYSDPTQWTAFLGLHDQSQRSAPGVQERRLKRIISHPFFNDTEGLDYDIALLELEKPAEYSSMVRPISLPDASHVFPAGKAIWVTGWGHTQYGGTNALILQKGEIRVINQTTCENLLPQLITPRMMCVGFLSGGVDSCEGDSGGPLSSVEADGRIFQAGVVSWGDGCAQRNKPGVYTRLPLFRDWIKENTGV

SEQ ID NO: 308 - protein, 242 aa, Artificial Sequence
  MEMBRANE TYPE SERINE PROTEASE 1 (MT-SP1) protease domain Q38H/I41S/D60bT/F60eS/ins97aV/F97D/T98P/F99L/C122S /G151H/Q175L/Q192E
VVGGTDADEGEWPWQVSLHALGHGHSCGASLISPNWLVSAAHCYIDTRGSRYSDPTQWTAFLGLHDQSQRSAPGVQERRLKRIISHPFFNDDVPLDYDIALLELEKPAEYSSMVRPISLPDASHVFPAGKAIWVTGWGHTQYGGTHALILQKGEIRVINQTTCENLLPQLITPRMMCVGFLSGGVDSCEGDSGGPLSSVEADGRIFQAGVVSWGDGCAQRNKPGVYTRLPLFRDWIKENTGV

SEQ ID NO: 309 - protein, 241 aa, Artificial Sequence
  MEMBRANE TYPE SERINE PROTEASE 1 (MT-SP1) protease domain Q38H/I41S/D60bV/F60eQ/Y60gF/ins97aE/F97T/T98G/F99L /C122S/Q175L/Q192I
VVGGTDADEGEWPWQVSLHALGHGHSCGASLISPNWLVSAAHCYIDVRGQRFSDPTQWTAFLGLHDQSQRSAPGVQERRLKRIISHPFFNDTEGLDYDIALLELEKPAEYSSMVRPSLPDASHVFPAGKAIWVTGWGHTQYGGTGALILQKGEIRVINQTTCENLLPQLITPRMMCVGFLSGGVDSCIGDSGGPLSSVEADGRIFQAGVVSWGDGCAQRNKPGVYTRLPLFRDWIKENTGV

SEQ ID NO: 310 - protein, 242 aa, Artificial Sequence
  MEMBRANE TYPE SERINE PROTEASE 1 (MT-SP1) protease domain Q38H/I41A/D60bV/F60eI/ins97aE/F97T/T98G/F99L/C122S /Q175L/Q192E
VVGGTDADEGEWPWQVSLHALGHGHACGASLISPNWLVSAAHCYIDVRGIRYSDPTQWTAFLGLHDQSQRSAPGVQERRLKRIISHPFFNDTEGLDYDIALLELEKPAEYSSMVRPISLPDASHVFPAGKAIWVTGWGHTQYGGTGALILQKGEIRVINQTTCENLLPQLITPRMMCVGFLSGGVDSCEGDSGGPLSSVEADGRIFQAGVVSWGDGCAQRNKPGVYTRLPLFRDWIKENTGV

SEQ ID NO: 311 - protein, 242 aa, Artificial Sequence
  MEMBRANE TYPE SERINE PROTEASE 1 (MT-SP1) protease domain Q38H/I41A/D60bV/F60eT/Y60gW/ins97aE/F97T/T98G/F99L /C122S/Q175L/Q192E
VVGGTDADEGEWPWQVSLHALGHGHACGASLISPNWLVSAAHCYIDVRGTRWSDPTQWTAFLGLHDQSQRSAPGVQERRLKRIISHPFFNDTEGLDYDIALLELEKPAEYSSMVRPISLPDASHVFPAGKAIWVTGWGHTQYGGTGALILQKGEIRVINQTTCENLLPQLITPRMMCVGFLSGGVDSCEGDSGGPLSSVEADGRIFQAGVVSWGDGCAQRNKPGVYTRLPLFRDWIKENTGV

SEQ ID NO: 312 - protein, 242 aa, Artificial Sequence
  MEMBRANE TYPE SERINE PROTEASE 1 (MT-SP1) protease domain Q38H/I41A/F60eA/Y60gW/ins97aE/F97T/T98G/F99L/C122S /Q175L/Q192E
VVGGTDADEGEWPWQVSLHALGHGHACGASLISPNWLVSAAHCYIDDRGARWSDPTQWTAFLGLHDQSQRSAPGVQERRLKRIISHPFFNDTEGLDYDIALLELEKPAEYSSMVRPISLPDASHVFPAGKAIWVTGWGHTQYGGTGALILQKGEIRVINQTTCENLLPQLITPRMMCVGFLSGGVDSCEGDSGGPLSSVEADGRIFQAGVVSWGDGCAQRNKPGVYTRLPLFRDWIKENTGV

SEQ ID NO: 313 - protein, 242 aa, Artificial Sequence
  MEMBRANE TYPE SERINE PROTEASE 1 (MT-SP1) protease domain Q38H/I41A/D60bE/F60eH/Y60gW/ins97aE/F97T/T98G/F99L /C122S/Q175L/Q192D
VVGGTDADEGEWPWQVSLHALGHGHACGASLISPNWLVSAAHCYIDERGHRWSDPTQWTAFLGLHDQSQRSAPGVQERRLKRIISHPFFNDTEGLDYDIALLELEKPAEYSSMVRPISLPDASHVFPAGKAIWVTGWGHTQYGGTGALILQKGEIRVINQTTCENLLPQLITPRMMCVGFLSGGVDSCDGDSGGPLSSVEADGRIFQAGVVSWGDGCAQRNKPGVYTRLPLFRDWIKENTGV

SEQ ID NO: 314 - protein, 242 aa, Artificial Sequence
  MEMBRANE TYPE SERINE PROTEASE 1 (MT-SP1) protease domain Q38H/I41A/D60bT/F60eK/Y60gW/ins97aE/F97T/T98G/F99L /C122S/Q175L/Q192D
VVGGTDADEGEWPWQVSLHALGHGHACGASLISPNWLVSAAHCYIDTRGKRWSDPTQWTAFLGLHDQSQRSAPGVQERRLKRIISHPFFNDTEGLDYDIALLELEKPAEYSSMVRPISLPDASHVFPAGKAIWVTGWGHTQYGGTGALILQKGEIRVINQTTCENLLPQLITPRMMCVGFLSGGVDSCDGDSGGPLSSVEADGRIFQAGVVSWGDGCAQRNKPGVYTRLPLFRDWIKENTGV

SEQ ID NO: 315 - protein, 242 aa, Artificial Sequence
  MEMBRANE TYPE SERINE PROTEASE 1 (MT-SP1) protease domain Q38H/I41A/D60bT/F60eH/Y60gW/ins97aE/F97T/T98G/F99L /C122S/Q175L/Q192D
VVGGTDADEGEWPWQVSLHALGHGHACGASLISPNWLVSAAHCYIDTRGHRWSDPTQWTAFLGLHDQSQRSAPGVQERRLKRIISHPFFNDTEGLDYDIALLELEKPAEYSSMVRPISLPDASHVFPAGKAIWVTGWGHTQYGGTGALILQKGEIRVINQTTCENLLPQLITPRMMCVGFLSGGVDSCDGDSGGPLSSVEADGRIFQAGVVSWGDGCAQRNKPGVYTRLPLFRDWIKENTGV

SEQ ID NO: 316 - protein, 242 aa, Artificial Sequence
  MEMBRANE TYPE SERINE PROTEASE 1 (MT-SP1) protease domain Q38H/I41S/D60bS/F60eR/Y60gW/F97T/ins97aE/T98G/F99L /C122S/Q175L/Q192E
VVGGTDADEGEWPWQVSLHALGHGHSCGASLISPNWLVSAAHCYIDSRGRRWSDPTQWTAFLGLHDQSQRSAPGVQERRLKRIISHPFFNDTEGLDYDIALLELEKPAEYSSMVRPISLPDASHVFPAGKAIWVTGWGHTQYGGTGALILQKGEIRVINQTTCENLLPQLITPRMMCVGFLSGGVDSCEGDSGGPLSSVEADGRIFQAGVVSWGDGCAQRNKPGVYTRLPLFRDWIKENTGV

SEQ ID NO: 317 - protein, 242 aa, Artificial Sequence
  MEMBRANE TYPE SERINE PROTEASE 1 (MT-SP1) protease domain Q38H/I41S/D60bT/F60eS/F97D/ins97aV/T98P/F99L/C122S /G151H/Q175L/Q192D
VVGGTDADEGEWPWQVSLHALGHGHSCGASLISPNWLVSAAHCYIDTRGSRYSDPTQWTAFLGLHDQSQRSAPGVQERRLKRIISHPFFNDDVPLDYDIALLELEKPAEYSSMVRPISLPDASHVFPAGKAIWVTGWGHTQYGGTHALILQKGEIRVINQTTCENLLPQLITPRMMCVGFLSGGVDSCDGDSGGPLSSVEADGRIFQAGVVSWGDGCAQRNKPGVYTRLPLFRDWIKENTGV

SEQ ID NO: 318 - protein, 242 aa, Artificial Sequence
  MEMBRANE TYPE SERINE PROTEASE 1 (MT-SP1) protease domain Q38R/I41T/ins97aE/F97T/T98G/F99L/C122S/G151N/Q175L /Q192G
VVGGTDADEGEWPWQVSLHALGRGHTCGASLISPNWLVSAAHCYIDDRGFRYSDPTQWTAFLGLHDQSQRSAPGVQERRLKRIISHPFFNDTEGLDYDIALLELEKPAEYSSMVRPISLPDASHVFPAGKAIWVTGWGHTQYGGTNALILQKGEIRVINQTTCENLLPQLITPRMMCVGFLSGGVDSCGGDSGGPLSSVEADGRIFQAGVVSWGDGCAQRNKPGVYTRLPLFRDWIKENTGV

SEQ ID NO: 319 - protein, 242 aa, Artificial Sequence
  MEMBRANE TYPE SERINE PROTEASE 1 (MT-SP1) protease domain Q38S/I41S/F60eR/F97T/ins97aE/T98G/F99L/C122S/G151N /Q175L/Q192S
VVGGTDADEGEWPWQVSLHALGSGHSCGASLISPNWLVSAAHCYIDDRGRRYSDPTQWTAFLGLHDQSQRSAPGVQERRLKRIISHPFFNDTEGLDYDIALLELEKPAEYSSMVRPISLPDASHVFPAGKAIWVTGWGHTQYGGTNALILQKGEIRVINQTTCENLLPQLITPRMMCVGFLSGGVDSCSGDSGGPLSSVEADGRIFQAGVVSWGDGCAQRNKPGVYTRLPLFRDWIKENTGV

SEQ ID NO: 320 - protein, 242 aa, Artificial Sequence
  MEMBRANE TYPE SERINE PROTEASE 1 (MT-SP1) protease domain Q38H/I41T/D60bV/F60eQ/F97T/ins97aE/T98G/F99L/C122S /Q175L/Q192G
VVGGTDADEGEWPWQVSLHALGHGHTCGASLISPNWLVSAAHCYIDVRGQRYSDPTQWTAFLGLHDQSQRSAPGVQERRLKRIISHPFFNDTEGLDYDIALLELEKPAEYSSMVRPISLPDASHVFPAGKAIWVTGWGHTQYGGTGALILQKGEIRVINQTTCENLLPQLITPRMMCVGFLSGGVDSCGGDSGGPLSSVEADGRIFQAGVVSWGDGCAQRNKPGVYTRLPLFRDWIKENTGV

SEQ ID NO: 321 - protein, 242 aa, Artificial Sequence
  MEMBRANE TYPE SERINE PROTEASE 1 (MT-SP1) protease domain Q38G/H40R/I41H/D60bH/F60eK/F97T/ins97aE/T98G/F99L/ C122S/Q175L/V183A/Q192G
VVGGTDADEGEWPWQVSLHALGGGRHCGASLISPNWLVSAAHCYIDHRGKRYSDPTQWTAFLGLHDQSQRSAPGVQERRLKRIISHPFFNDTEGLDYDIALLELEKPAEYSSMVRPISLPDASHVFPAGKAIWVTGWGHTQYGGTGALILQKGEIRVINQTTCENLLPQLITPRMMCAGFLSGGVDSCGGDSGGPLSSVEADGRIFQAGVVSWGDGCAQRNKPGVYTRLPLFRDWIKENTGV

SEQ ID NO: 322 - protein, 242 aa, Artificial Sequence
  MEMBRANE TYPE SERINE PROTEASE 1 (MT-SP1) protease domain Q38H/I41A/F97T/ins97aE/T98G/F99L/C122S/Q175L/Q192G
VVGGTDADEGEWPWQVSLHALGHGHACGASLISPNWLVSAAHCYIDDRGFRYSDPTQWTAFLGLHDQSQRSAPGVQERRLKRIISHPFFNDTEGLDYDIALLELEKPAEYSSMVRPISLPDASHVFPAGKAIWVTGWGHTQYGGTGALILQKGEIRVINQTTCENLLPQLITPRMMCVGFLSGGVDSCGGDSGGPLSSVEADGRIFQAGVVSWGDGCAQRNKPGVYTRLPLFRDWIKENTGV

SEQ ID NO: 323 - protein, 242 aa, Artificial Sequence
  MEMBRANE TYPE SERINE PROTEASE 1 (MT-SP1) protease domain Q38L/I41T/D60bR/F60eL/Y60gM/F97T/ins97aE/T98G/F99L /C122S/G151N/Q175L/Q192G
VVGGTDADEGEWPWQVSLHALGLGHTCGASLISPNWLVSAAHCYIDRRGLRMSDPTQWTAFLGLHDQSQRSAPGVQERRLKRIISHPFFNDTEGLDYDIALLELEKPAEYSSMVRPISLPDASHVFPAGKAIWVTGWGHTQYGGTNALILQKGEIRVINQTTCENLLPQLITPRMMCVGFLSGGVDSCGGDSGGPLSSVEADGRIFQAGVVSWGDGCAQRNKPGVYTRLPLFRDWIKENTGV

SEQ ID NO: 324 - protein, 242 aa, Artificial Sequence
  MEMBRANE TYPE SERINE PROTEASE 1 (MT-SP1) protease domain Q38F/I41S/D60bF/F60eR/Y60gF/F97T/ins97aE/T98G/F99L /C122S/G151N/Q175L/Q192V
VVGGTDADEGEWPWQVSLHALGFGHSCGASLISPNWLVSAAHCYIDFRGRRFSDPTQWTAFLGLHDQSQRSAPGVQERRLKRIISHPFFNDTEGLDYDIALLELEKPAEYSSMVRPISLPDASHVFPAGKAIWVTGWGHTQYGGTNALILQKGEIRVINQTTCENLLPQLITPRMMCVGFLSGGVDSCVGDSGGPLSSVEADGRIFQAGVVSWGDGCAQRNKPGVYTRLPLFRDWIKENTGV

SEQ ID NO: 325 - protein, 242 aa, Artificial Sequence
  MEMBRANE TYPE SERINE PROTEASE 1 (MT-SP1) protease domain Q38V/I41S/D60bT/F60eT/F97D/ins97aV/T98P/F99L/C122S /G151N/Q175H/Q192S
VVGGTDADEGEWPWQVSLHALGVGHSCGASLISPNWLVSAAHCYIDTRGTRYSDPTQWTAFLGLHDQSQRSAPGVQERRLKRIISHPFFNDDVPLDYDIALLELEKPAEYSSMVRPISLPDASHVFPAGKAIWVTGWGHTQYGGTNALILQKGEIRVINQTTCENLLPQHITPRMMCVGFLSGGVDSCSGDSGGPLSSVEADGRIFQAGVVSWGDGCAQRNKPGVYTRLPLFRDWIKENTGV

SEQ ID NO: 326 - protein, 242 aa, Artificial Sequence
  MEMBRANE TYPE SERINE PROTEASE 1 (MT-SP1) protease domain Q38W/I41A/ins97aV/F97D/T98P/F99L/C122S/G151T/Q175S /Q192D
VVGGTDADEGEWPWQVSLHALGWGHACGASLISPNWLVSAAHCYIDDRGFRYSDPTQWTAFLGLHDQSQRSAPGVQERRLKRIISHPFFNDDVPLDYDIALLELEKPAEYSSMVRPISLPDASHVFPAGKAIWVTGWGHTQYGGTTALILQKGEIRVINQTTCENLLPQSITPRMMCVGFLSGGVDSCDGDSGGPLSSVEADGRIFQAGVVSWGDGCAQRNKPGVYTRLPLFRDWIKENTGV

SEQ ID NO: 327 - protein, 242 aa, Artificial Sequence
  MEMBRANE TYPE SERINE PROTEASE 1 (MT-SP1) protease domain Q38T/I41S/D60bV/F60eR/ins97aV/F97D/T98P/F99L/C122S /G151N/Q175R/Q192V
VVGGTDADEGEWPWQVSLHALGTGHSCGASLISPNWLVSAAHCYIDVRGRRYSDPTQWTAFLGLHDQSQRSAPGVQERRLKRIISHPFFNDDVPLDYDIALLELEKPAEYSSMVRPISLPDASHVFPAGKAIWVTGWGHTQYGGTNALILQKGEIRVINQTTCENLLPQRITPRMMCVGFLSGGVDSCVGDSGGPLSSVEADGRIFQAGVVSWGDGCAQRNKPGVYTRLPLFRDWIKENTGV

SEQ ID NO: 328 - protein, 242 aa, Artificial Sequence
  MEMBRANE TYPE SERINE PROTEASE 1 (MT-SP1) protease domain Q38H/I41S/D60bT/F60eS/ins97aV/F97D/T98P/F99L/C122S /G151H/Q175A/Q192D
VVGGTDADEGEWPWQVSLHALGHGHSCGASLISPNWLVSAAHCYIDTRGSRYSDPTQWTAFLGLHDQSQRSAPGVQERRLKRIISHPFFNDDVPLDYDIALLELEKPAEYSSMVRPISLPDASHVFPAGKAIWVTGWGHTQYGGTHALILQKGEIRVINQTTCENLLPQAITPRMMCVGFLSGGVDSCDGDSGGPLSSVEADGRIFQAGVVSWGDGCAQRNKPGVYTRLPLFRDWIKENTGV

SEQ ID NO: 329 - protein, 242 aa, Artificial Sequence
  MEMBRANE TYPE SERINE PROTEASE 1 (MT-SP1) protease domain Q38H/I41S/D60bT/F60eT/F97D/ins97aV/T98P/F99L/C122S /G151N/Q175L/Q192V
VVGGTDADEGEWPWQVSLHALGHGHSCGASLISPNWLVSAAHCYIDTRGTRYSDPTQWTAFLGLHDQSQRSAPGVQERRLKRIISHPFFNDDVPLDYDIALLELEKPAEYSSMVRPISLPDASHVFPAGKAIWVTGWGHTQYGGTNALILQKGEIRVINQTTCENLLPQLITPRMMCVGFLSGGVDSCVGDSGGPLSSVEADGRIFQAGVVSWGDGCAQRNKPGVYTRLPLFRDWIKENTGV

SEQ ID NO: 330 - protein, 242 aa, Artificial Sequence
  MEMBRANE TYPE SERINE PROTEASE 1 (MT-SP1) protease domain Q38Y/I41A/D60bL/F60eQ/ins97aV/F97D/T98P/F99L/C122S /G151N/Q175M/Q192A
VVGGTDADEGEWPWQVSLHALGYGHACGASLISPNWLVSAAHCYIDLRGQRYSDPTQWTAFLGLHDQSQRSAPGVQERRLKRIISHPFFNDDVPLDYDIALLELEKPAEYSSMVRPISLPDASHVFPAGKAIWVTGWGHTQYGGTNALILQKGEIRVINQTTCENLLPQMITPRMMCVGFLSGGVDSCAGDSGGPLSSVEADGRIFQAGVVSWGDGCAQRNKPGVYTRLPLFRDWIKENTGV

SEQ ID NO: 331 - protein, 242 aa, Artificial Sequence
  MEMBRANE TYPE SERINE PROTEASE 1 (MT-SP1) protease domain Q38L/I41T/D60bA/F60eL/ins97aV/F97D/T98P/F99L/C122S /G151H/Q175M/Q192T
VVGGTDADEGEWPWQVSLHALGLGHTCGASLISPNWLVSAAHCYIDARGLRYSDPTQWTAFLGLHDQSQRSAPGVQERRLKRIISHPFFNDDVPLDYDIALLELEKPAEYSSMVRPISLPDASHVFPAGKAIWVTGWGHTQYGGTHALILQKGEIRVINQTTCENLLPQMITPRMMCVGFLSGGVDSCTGDSGGPLSSVEADGRIFQAGVVSWGDGCAQRNKPGVYTRLPLFRDWIKENTGV

SEQ ID NO: 332 - protein, 242 aa, Artificial Sequence
  MEMBRANE TYPE SERINE PROTEASE 1 (MT-SP1) protease domain Q38R/I41S/D60bY/F60eD/ins97aV/F97D/T98P/F99L/C122S /G151N/Q175M/Q192A
VVGGTDADEGEWPWQVSLHALGRGHSCGASLISPNWLVSAAHCYIDYRGDRYSDPTQWTAFLGLHDQSQRSAPGVQERRLKRIISHPFFNDDVPLDYDIALLELEKPAEYSSMVRPISLPDASHVFPAGKAIWVTGWGHTQYGGTNALILQKGEIRVINQTTCENLLPQMITPRMMCVGFLSGGVDSCAGDSGGPLSSVEADGRIFQAGVVSWGDGCAQRNKPGVYTRLPLFRDWIKENTGV

SEQ ID NO: 333 - protein, 242 aa, Artificial Sequence
  MEMBRANE TYPE SERINE PROTEASE 1 (MT-SP1) protease domain Q38W/I41S/D60bG/F60eI/F97D/ins97aV/T98P/F99L/C122S /G151N/Q175A/Q192D
VVGGTDADEGEWPWQVSLHALGWGHSCGASLISPNWLVSAAHCYIDGRGIRYSDPTQWTAFLGLHDQSQRSAPGVQERRLKRIISHPFFNDDVPLDYDIALLELEKPAEYSSMVRPISLPDASHVFPAGKAIWVTGWGHTQYGGTNALILQKGEIRVINQTTCENLLPQAITPRMMCVGFLSGGVDSCDGDSGGPLSSVEADGRIFQAGVVSWGDGCAQRNKPGVYTRLPLFRDWIKENTGV

SEQ ID NO: 334 - protein, 242 aa, Artificial Sequence
  MEMBRANE TYPE SERINE PROTEASE 1 (MT-SP1) protease domain Q38T/I41S/D60bG/F60eM/ins97aV/F97D/T98P/F99L/C122S /G151N/Q175S/Q192S
VVGGTDADEGEWPWQVSLHALGTGHSCGASLISPNWLVSAAHCYIDGRGMRYSDPTQWTAFLGLHDQSQRSAPGVQERRLKRIISHPFFNDDVPLDYDIALLELEKPAEYSSMVRPISLPDASHVFPAGKAIWVTGWGHTQYGGTNALILQKGEIRVINQTTCENLLPQSITPRMMCVGFLSGGVDSCSGDSGGPLSSVEADGRIFQAGVVSWGDGCAQRNKPGVYTRLPLFRDWIKENTGV

SEQ ID NO: 335 - protein, 242 aa, Artificial Sequence
  MEMBRANE TYPE SERINE PROTEASE 1 (MT-SP1) protease domain I41T/D60bW/F60eH/F97D/ins97aV/T98P/F99L/C122S/G151 N/Q175L/Q192G
VVGGTDADEGEWPWQVSLHALGQGHTCGASLISPNWLVSAAHCYIDWRGHRYSDPTQWTAFLGLHDQSQRSAPGVQERRLKRIISHPFFNDDVPLDYDIALLELEKPAEYSSMVRPISLPDASHVFPAGKAIWVTGWGHTQYGGTNALILQKGEIRVINQTTCENLLPQLITPRMMCVGFLSGGVDSCGGDSGGPLSSVEADGRIFQAGVVSWGDGCAQRNKPGVYTRLPLFRDWIKENTGV

SEQ ID NO: 336 - protein, 242 aa, Artificial Sequence
  MEMBRANE TYPE SERINE PROTEASE 1 (MT-SP1) protease domain Q38D/I41S/D60bT/F60eR/ins97aV/F97D/T98P/F99L/C122S /G151K/Q175S/Q192V
VVGGTDADEGEWPWQVSLHALGDGHSCGASLISPNWLVSAAHCYIDTRGRRYSDPTQWTAFLGLHDQSQRSAPGVQERRLKRIISHPFFNDDVPLDYDIALLELEKPAEYSSMVRPISLPDASHVFPAGKAIWVTGWGHTQYGGTKALILQKGEIRVINQTTCENLLPQSITPRMMCVGFLSGGVDSCVGDSGGPLSSVEADGRIFQAGVVSWGDGCAQRNKPGVYTRLPLFRDWIKENTGV

SEQ ID NO: 337 - protein, 242 aa, Artificial Sequence
  MEMBRANE TYPE SERINE PROTEASE 1 (MT-SP1) protease domain Q38H/I41S/D60bF/F60eV/F97D/ins97aV/T98P/F99L/C122S /G151N/Q175L/Q192A
VVGGTDADEGEWPWQVSLHALGHGHSCGASLISPNWLVSAAHCYIDFRGVRYSDPTQWTAFLGLHDQSQRSAPGVQERRLKRIISHPFFNDDVPLDYDIALLELEKPAEYSSMVRPISLPDASHVFPAGKAIWVTGWGHTQYGGTNALILQKGEIRVINQTTCENLLPQLITPRMMCVGFLSGGVDSCAGDSGGPLSSVEADGRIFQAGVVSWGDGCAQRNKPGVYTRLPLFRDWIKENTGV

SEQ ID NO: 338 - protein, 242 aa, Artificial Sequence
  MEMBRANE TYPE SERINE PROTEASE 1 (MT-SP1) protease domain Q38L/I41A/D60bH/F60eT/ins97aV/F97D/T98P/F99L/C122S /G151Q/Q175A/Q192G
VVGGTDADEGEWPWQVSLHALGLGHACGASLISPNWLVSAAHCYIDHRGTRYSDPTQWTAFLGLHDQSQRSAPGVQERRLKRIISHPFFNDDVPLDYDIALLELEKPAEYSSMVRPISLPDASHVFPAGKAIWVTGWGHTQYGGTQALILQKGEIRVINQTTCENLLPQAITPRMMCVGFLSGGVDSCGGDSGGPLSSVEADGRIFQAGVVSWGDGCAQRNKPGVYTRLPLFRDWIKENTGV

SEQ ID NO: 339 - protein, 242 aa, Artificial Sequence
  MEMBRANE TYPE SERINE PROTEASE 1 (MT-SP1) protease domain Q38H/I41A/D60bE/F60eH/Y60gW/F97T/ins97aE/T98G/F99L /C122S/G151N/Q175L/Q192D
VVGGTDADEGEWPWQVSLHALGHGHACGASLISPNWLVSAAHCYIDERGHRWSDPTQWTAFLGLHDQSQRSAPGVQERRLKRIISHPFFNDTEGLDYDIALLELEKPAEYSSMVRPISLPDASHVFPAGKAIWVTGWGHTQYGGTNALILQKGEIRVINQTTCENLLPQLITPRMMCVGFLSGGVDSCDGDSGGPLSSVEADGRIFQAGVVSWGDGCAQRNKPGVYTRLPLFRDWIKENTGV

SEQ ID NO: 340 - protein, 242 aa, Artificial Sequence
  MEMBRANE TYPE SERINE PROTEASE 1 (MT-SP1) protease domain Q38H/I41A/D60bV/F60eI/Y60gW/F97T/ins97aE/T98G/F99L /C122S/G151N/Q175L/Q192D
VVGGTDADEGEWPWQVSLHALGHGHACGASLISPNWLVSAAHCYIDVRGIRWSDPTQWTAFLGLHDQSQRSAPGVQERRLKRIISHPFFNDTEGLDYDIALLELEKPAEYSSMVRPISLPDASHVFPAGKAIWVTGWGHTQYGGTNALILQKGEIRVINQTTCENLLPQLITPRMMCVGFLSGGVDSCDGDSGGPLSSVEADGRIFQAGVVSWGDGCAQRNKPGVYTRLPLFRDWIKENTGV

SEQ ID NO: 341 - protein, 242 aa, Artificial Sequence
  MEMBRANE TYPE SERINE PROTEASE 1 (MT-SP1) protease domain Q38E/I41S/D60bV/F60eK/Y60gW/F97T/ins97aE/T98G/F99L /C122S/G151N/Q175L/Q192D
VVGGTDADEGEWPWQVSLHALGEGHSCGASLISPNWLVSAAHCYIDVRGKRWSDPTQWTAFLGLHDQSQRSAPGVQERRLKRIISHPFFNDTEGLDYDIALLELEKPAEYSSMVRPISLPDASHVFPAGKAIWVTGWGHTQYGGTNALILQKGEIRVINQTTCENLLPQLITPRMMCVGFLSGGVDSCDGDSGGPLSSVEADGRIFQAGVVSWGDGCAQRNKPGVYTRLPLFRDWIKENTGV

SEQ ID NO: 342 - protein, 242 aa, Artificial Sequence; identical to SEQ ID NO: 25
  MEMBRANE TYPE SERINE PROTEASE 1 (MT-SP1) protease domain Q38H/I41S/D60bT/F60eS/Y60gW/ins97aV/F97D/T98P/F99L /C122S/G151H/Q175L/Q192D

SEQ ID NO: 343 - protein, 242 aa, Artificial Sequence
  MEMBRANE TYPE SERINE PROTEASE 1 (MT-SP1) protease domain Q38H/I41S/D60bT/F60eS/Y60gW/F97D/ins97aV/T98P/F99L /C122S/G151H/Q175A/Q192D
VVGGTDADEGEWPWQVSLHALGHGHSCGASLISPNWLVSAAHCYIDTRGSRWSDPTQWTAFLGLHDQSQRSAPGVQERRLKRIISHPFFNDDVPLDYDIALLELEKPAEYSSMVRPISLPDASHVFPAGKAIWVTGWGHTQYGGTHALILQKGEIRVINQTTCENLLPQAITPRMMCVGFLSGGVDSCDGDSGGPLSSVEADGRIFQAGVVSWGDGCAQRNKPGVYTRLPLFRDWIKENTGV

SEQ ID NO: 344 - protein, 242 aa, Artificial Sequence
  MEMBRANE TYPE SERINE PROTEASE 1 (MT-SP1) protease domain Q38H/I41A/D60bV/F60eR/ins97aE/F97T/T98G/F99L/C122S /G151N/Q175L/Q192D
VVGGTDADEGEWPWQVSLHALGHGHACGASLISPNWLVSAAHCYIDVRGRRYSDPTQWTAFLGLHDQSQRSAPGVQERRLKRIISHPFFNDTEGLDYDIALLELEKPAEYSSMVRPISLPDASHVFPAGKAIWVTGWGHTQYGGTNALILQKGEIRVINQTTCENLLPQLITPRMMCVGFLSGGVDSCDGDSGGPLSSVEADGRIFQAGVVSWGDGCAQRNKPGVYTRLPLFRDWIKENTGV

SEQ ID NO: 345 - protein, 242 aa, Artificial Sequence
  MEMBRANE TYPE SERINE PROTEASE 1 (MT-SP1) protease domain Q38H/I41A/D60bT/F60eH/Y60gW/F97T/ins97aE/T98G/F99L /C122S/G151N/Q175L/Q192D
VVGGTDADEGEWPWQVSLHALGHGHACGASLISPNWLVSAAHCYIDTRGHRWSDPTQWTAFLGLHDQSQRSAPGVQERRLKRIISHPFFNDTEGLDYDIALLELEKPAEYSSMVRPISLPDASHVFPAGKAIWVTGWGHTQYGGTNALILQKGEIRVINQTTCENLLPQLITPRMMCVGFLSGGVDSCDGDSGGPLSSVEADGRIFQAGVVSWGDGCAQRNKPGVYTRLPLFRDWIKENTGV

SEQ ID NO: 346 - protein, 242 aa, Artificial Sequence
  MEMBRANE TYPE SERINE PROTEASE 1 (MT-SP1) protease domain D60bY/F97T/ins97aE/T98G/F99L/C122S/Q175L/Q192G
VVGGTDADEGEWPWQVSLHALGQGHICGASLISPNWLVSAAHCYIDYRGFRYSDPTQWTAFLGLHDQSQRSAPGVQERRLKRIISHPFFNDTEGLDYDIALLELEKPAEYSSMVRPISLPDASHVFPAGKAIWVTGWGHTQYGGTGALILQKGEIRVINQTTCENLLPQLITPRMMCVGFLSGGVDSCGGDSGGPLSSVEADGRIFQAGVVSWGDGCAQRNKPGVYTRLPLFRDWIKENTGV

SEQ ID NO: 347 - protein, 242 aa, Artificial Sequence
  MEMBRANE TYPE SERINE PROTEASE 1 (MT-SP1) protease domain I41T/D60bY/F97T/ins97aE/T98G/F99L/C122S/Q175L/Q192 G
VVGGTDADEGEWPWQVSLHALGQGHTCGASLISPNWLVSAAHCYIDYRGFRYSDPTQWTAFLGLHDQSQRSAPGVQERRLKRIISHPFFNDTEGLDYDIALLELEKPAEYSSMVRPISLPDASHVFPAGKAIWVTGWGHTQYGGTGALILQKGEIRVINQTTCENLLPQLITPRMMCVGFLSGGVDSCGGDSGGPLSSVEADGRIFQAGVVSWGDGCAQRNKPGVYTRLPLFRDWIKENTGV

SEQ ID NO: 348 - protein, 242 aa, Artificial Sequence
  MEMBRANE TYPE SERINE PROTEASE 1 (MT-SP1) protease domain Q38E/I41S/D60bT/F60eR/F97T/ins97aE/T98G/F99L/C122S /Q175L/Q192V
VVGGTDADEGEWPWQVSLHALGEGHSCGASLISPNWLVSAAHCYIDTRGRRYSDPTQWTAFLGLHDQSQRSAPGVQERRLKRIISHPFFNDTEGLDYDIALLELEKPAEYSSMVRPISLPDASHVFPAGKAIWVTGWGHTQYGGTGALILQKGEIRVINQTTCENLLPQLITPRMMCVGFLSGGVDSCVGDSGGPLSSVEADGRIFQAGVVSWGDGCAQRNKPGVYTRLPLFRDWIKENTGV

SEQ ID NO: 349 - protein, 242 aa, Artificial Sequence
  MEMBRANE TYPE SERINE PROTEASE 1 (MT-SP1) protease domain Q38H/I41A/D60bK/F60eK/Y60gW/F97T/ins97aE/T98G/F99L /C122S/Q175L/Q192D
VVGGTDADEGEWPWQVSLHALGHGHACGASLISPNWLVSAAHCYIDKRGKRWSDPTQWTAFLGLHDQSQRSAPGVQERRLKRIISHPFFNDTEGLDYDIALLELEKPAEYSSMVRPISLPDASHVFPAGKAIWVTGWGHTQYGGTGALILQKGEIRVINQTTCENLLPQLITPRMMCVGFLSGGVDSCDGDSGGPLSSVEADGRIFQAGVVSWGDGCAQRNKPGVYTRLPLFRDWIKENTGV

SEQ ID NO: 350 - protein, 242 aa, Artificial Sequence
  MEMBRANE TYPE SERINE PROTEASE 1 (MT-SP1) protease domain Q38H/I41S/D60bA/F60eV/ins97aE/F97T/T98G/F99L/C122S /Q175L/Q192E/Q209L
VVGGTDADEGEWPWQVSLHALGHGHSCGASLISPNWLVSAAHCYIDARGVRYSDPTQWTAFLGLHDQSQRSAPGVQERRLKRIISHPFFNDTEGLDYDIALLELEKPAEYSSMVRPISLPDASHVFPAGKAIWVTGWGHTQYGGTGALILQKGEIRVINQTTCENLLPQLITPRMMCVGFLSGGVDSCEGDSGGPLSSVEADGRIFLAGVVSWGDGCAQRNKPGVYTRLPLFRDWIKENTGV

SEQ ID NO: 351 - protein, 242 aa, Artificial Sequence
  MEMBRANE TYPE SERINE PROTEASE 1 (MT-SP1) protease domain Q38H/I41A/D60bT/F60eR/F97T/ins97aE/T98G/F99L/C122S /Q175L/Q192V
VVGGTDADEGEWPWQVSLHALGHGHACGASLISPNWLVSAAHCYIDTRGRRYSDPTQWTAFLGLHDQSQRSAPGVQERRLKRIISHPFFNDTEGLDYDIALLELEKPAEYSSMVRPISLPDASHVFPAGKAIWVTGWGHTQYGGTGALILQKGEIRVINQTTCENLLPQLITPRMMCVGFLSGGVDSCVGDSGGPLSSVEADGRIFQAGVVSWGDGCAQRNKPGVYTRLPLFRDWIKENTGV

SEQ ID NO: 352 - protein, 242 aa, Artificial Sequence
  MEMBRANE TYPE SERINE PROTEASE 1 (MT-SP1) protease domain Q38K/I41S/F97T/ins97aE/T98G/F99L/C122S/Q175L/Q192V
VVGGTDADEGEWPWQVSLHALGKGHSCGASLISPNWLVSAAHCYIDDRGFRYSDPTQWTAFLGLHDQSQRSAPGVQERRLKRIISHPFFNDTEGLDYDIALLELEKPAEYSSMVRPISLPDASHVFPAGKAIWVTGWGHTQYGGTGALILQKGEIRVINQTTCENLLPQLITPRMMCVGFLSGGVDSCVGDSGGPLSSVEADGRIFQAGVVSWGDGCAQRNKPGVYTRLPLFRDWIKENTGV

SEQ ID NO: 353 - protein, 242 aa, Artificial Sequence
  MEMBRANE TYPE SERINE PROTEASE 1 (MT-SP1) protease domain Q38F/I41A/D60bT/F60eG/Y60gW/ins97aE/F97T/T98G/F99L /C122S/Q175L/Q192E
VVGGTDADEGEWPWQVSLHALGFGHACGASLISPNWLVSAAHCYIDTRGGRWSDPTQWTAFLGLHDQSQRSAPGVQERRLKRIISHPFFNDTEGLDYDIALLELEKPAEYSSMVRPISLPDASHVFPAGKAIWVTGWGHTQYGGTGALILQKGEIRVINQTTCENLLPQLITPRMMCVGFLSGGVDSCEGDSGGPLSSVEADGRIFQAGVVSWGDGCAQRNKPGVYTRLPLFRDWIKENTGV

SEQ ID NO: 354 - protein, 242 aa, Artificial Sequence
  MEMBRANE TYPE SERINE PROTEASE 1 (MT-SP1) protease domain Q38H/I41A/F60eH/Y60gW/ins97aE/F97T/T98G/F99L/C122S /Q175L/Q192A
VVGGTDADEGEWPWQVSLHALGHGHACGASLISPNWLVSAAHCYIDDRGHRWSDPTQWTAFLGLHDQSQRSAPGVQERRLKRIISHPFFNDTEGLDYDIALLELEKPAEYSSMVRPISLPDASHVFPAGKAIWVTGWGHTQYGGTGALILQKGEIRVINQTTCENLLPQLITPRMMCVGFLSGGVDSCAGDSGGPLSSVEADGRIFQAGVVSWGDGCAQRNKPGVYTRLPLFRDWIKENTGV

SEQ ID NO: 355 - protein, 242 aa, Artificial Sequence
  MEMBRANE TYPE SERINE PROTEASE 1 (MT-SP1) protease domain Q38H/I41A/D60bT/F60eK/Y60gW/F97T/ins97aE/T98G/F99L /C122S/Q175L/Q192A
VVGGTDADEGEWPWQVSLHALGHGHACGASLISPNWLVSAAHCYIDTRGKRWSDPTQWTAFLGLHDQSQRSAPGVQERRLKRIISHPFFNDTEGLDYDIALLELEKPAEYSSMVRPISLPDASHVFPAGKAIWVTGWGHTQYGGTGALILQKGEIRVINQTTCENLLPQLITPRMMCVGFLSGGVDSCAGDSGGPLSSVEADGRIFQAGVVSWGDGCAQRNKPGVYTRLPLFRDWIKENTGV

SEQ ID NO: 356 - protein, 242 aa, Artificial Sequence
  MEMBRANE TYPE SERINE PROTEASE 1 (MT-SP1) protease domain Q38H/I41A/D60bV/F60eA/Y60gW/F97T/ins97aE/T98G/F99L /C122S/Q175L/Q192V
VVGGTDADEGEWPWQVSLHALGHGHACGASLISPNWLVSAAHCYIDVRGARWSDPTQWTAFLGLHDQSQRSAPGVQERRLKRIISHPFFNDTEGLDYDIALLELEKPAEYSSMVRPISLPDASHVFPAGKAIWVTGWGHTQYGGTGALILQKGEIRVINQTTCENLLPQLITPRMMCVGFLSGGVDSCVGDSGGPLSSVEADGRIFQAGVVSWGDGCAQRNKPGVYTRLPLFRDWIKENTGV

SEQ ID NO: 357 - protein, 242 aa, Artificial Sequence
  MEMBRANE TYPE SERINE PROTEASE 1 (MT-SP1) protease domain Q38E/I41V/D60bF/F60eK/Y60gF/F97T/ins97aE/T98G/F99L /C122S/Q175L/Q192G
VVGGTDADEGEWPWQVSLHALGEGHVCGASLISPNWLVSAAHCYIDFRGKRFSDPTQWTAFLGLHDQSQRSAPGVQERRLKRIISHPFFNDTEGLDYDIALLELEKPAEYSSMVRPISLPDASHVFPAGKAIWVTGWGHTQYGGTGALILQKGEIRVINQTTCENLLPQLITPRMMCVGFLSGGVDSCGGDSGGPLSSVEADGRIFQAGVVSWGDGCAQRNKPGVYTRLPLFRDWIKENTGV

SEQ ID NO: 358 - protein, 242 aa, Artificial Sequence
  MEMBRANE TYPE SERINE PROTEASE 1 (MT-SP1) protease domain Q38H/H40P/I41A/F60eQ/Y60gW/F97T/ins97aE/T98G/F99L/ C122S/Q175L/Q192D
VVGGTDADEGEWPWQVSLHALGHGPACGASLISPNWLVSAAHCYIDDRGQRWSDPTQWTAFLGLHDQSQRSAPGVQERRLKRIISHPFFNDTEGLDYDIALLELEKPAEYSSMVRPISLPDASHVFPAGKAIWVTGWGHTQYGGTGALILQKGEIRVINQTTCENLLPQLITPRMMCVGFLSGGVDSCDGDSGGPLSSVEADGRIFQAGVVSWGDGCAQRNKPGVYTRLPLFRDWIKENTGV

SEQ ID NO: 359 - protein, 242 aa, Artificial Sequence
  MEMBRANE TYPE SERINE PROTEASE 1 (MT-SP1) protease domain Q38R/I41V/D60bV/F60eV/Y60gF/ins97aE/F97T/T98G/F99L /C122S/Q175L/Q192G
VVGGTDADEGEWPWQVSLHALGRGHVCGASLISPNWLVSAAHCYIDVRGVRFSDPTQWTAFLGLHDQSQRSAPGVQERRLKRIISHPFFNDTEGLDYDIALLELEKPAEYSSMVRPISLPDASHVFPAGKAIWVTGWGHTQYGGTGALILQKGEIRVINQTTCENLLPQLITPRMMCVGFLSGGVDSCGGDSGGPLSSVEADGRIFQAGVVSWGDGCAQRNKPGVYTRLPLFRDWIKENTGV

SEQ ID NO: 360 - protein, 242 aa, Artificial Sequence
  MEMBRANE TYPE SERINE PROTEASE 1 (MT-SP1) protease domain Q38L/H40P/I41T/D60bV/F60eH/Y60gL/ins97aE/F97T/T98G /F99L/C122S/Q175L/Q192A
VVGGTDADEGEWPWQVSLHALGLGPTCGASLISPNWLVSAAHCYIDVRGHRLSDPTQWTAFLGLHDQSQRSAPGVQERRLKRIISHPFFNDTEGLDYDIALLELEKPAEYSSMVRPISLPDASHVFPAGKAIWVTGWGHTQYGGTGALILQKGEIRVINQTTCENLLPQLITPRMMCVGFLSGGVDSCAGDSGGPLSSVEADGRIFQAGVVSWGDGCAQRNKPGVYTRLPLFRDWIKENTGV

SEQ ID NO: 361 - protein, 242 aa, Artificial Sequence
  MEMBRANE TYPE SERINE PROTEASE 1 (MT-SP1) protease domain Q38H/I41A/D60bV/F60eH/ins97aE/F97T/T98G/F99L/C122S /Q175L/Q192D
VVGGTDADEGEWPWQVSLHALGHGHACGASLISPNWLVSAAHCYIDVRGHRYSDPTQWTAFLGLHDQSQRSAPGVQERRLKRIISHPFFNDTEGLDYDIALLELEKPAEYSSMVRPISLPDASHVFPAGKAIWVTGWGHTQYGGTGALILQKGEIRVINQTTCENLLPQLITPRMMCVGFLSGGVDSCDGDSGGPLSSVEADGRIFQAGVVSWGDGCAQRNKPGVYTRLPLFRDWIKENTGV

SEQ ID NO: 362 - protein, 242 aa, Artificial Sequence
  MEMBRANE TYPE SERINE PROTEASE 1 (MT-SP1) protease domain Q38H/I41S/D60bA/F60eV/ins97aE/F97T/T98G/F99L/C122S /Q175L/Q192V
VVGGTDADEGEWPWQVSLHALGHGHSCGASLISPNWLVSAAHCYIDARGVRYSDPTQWTAFLGLHDQSQRSAPGVQERRLKRIISHPFFNDTEGLDYDIALLELEKPAEYSSMVRPISLPDASHVFPAGKAIWVTGWGHTQYGGTGALILQKGEIRVINQTTCENLLPQLITPRMMCVGFLSGGVDSCVGDSGGPLSSVEADGRIFQAGVVSWGDGCAQRNKPGVYTRLPLFRDWIKENTGV

SEQ ID NO: 363 - protein, 242 aa, Artificial Sequence
  MEMBRANE TYPE SERINE PROTEASE 1 (MT-SP1) protease domain Q38R/I41T/D60bH/ins97aE/F97T/T98G/F99L/C122S/Q175L /Q192G
VVGGTDADEGEWPWQVSLHALGRGHTCGASLISPNWLVSAAHCYIDHRGFRYSDPTQWTAFLGLHDQSQRSAPGVQERRLKRIISHPFFNDTEGLDYDIALLELEKPAEYSSMVRPISLPDASHVFPAGKAIWVTGWGHTQYGGTGALILQKGEIRVINQTTCENLLPQLITPRMMCVGFLSGGVDSCGGDSGGPLSSVEADGRIFQAGVVSWGDGCAQRNKPGVYTRLPLFRDWIKENTGV

SEQ ID NO: 364 - protein, 242 aa, Artificial Sequence
  MEMBRANE TYPE SERINE PROTEASE 1 (MT-SP1) protease domain Q38H/I41S/D60bT/F60eR/ins97aE/F97T/T98G/F99L/C122S /Q175L/Q192E
VVGGTDADEGEWPWQVSLHALGHGHSCGASLISPNWLVSAAHCYIDTRGRRYSDPTQWTAFLGLHDQSQRSAPGVQERRLKRIISHPFFNDTEGLDYDIALLELEKPAEYSSMVRPISLPDASHVFPAGKAIWVTGWGHTQYGGTGALILQKGEIRVINQTTCENLLPQLITPRMMCVGFLSGGVDSCEGDSGGPLSSVEADGRIFQAGVVSWGDGCAQRNKPGVYTRLPLFRDWIKENTGV

SEQ ID NO: 365 - protein, 242 aa, Artificial Sequence
  MEMBRANE TYPE SERINE PROTEASE 1 (MT-SP1) protease domain Q38K/I41T/ins97aE/F97T/T98G/F99L/C122S/Q175L/Q192A
VVGGTDADEGEWPWQVSLHALGKGHTCGASLISPNWLVSAAHCYIDDRGFRYSDPTQWTAFLGLHDQSQRSAPGVQERRLKRIISHPFFNDTEGLDYDIALLELEKPAEYSSMVRPISLPDASHVFPAGKAIWVTGWGHTQYGGTGALILQKGEIRVINQTTCENLLPQLITPRMMCVGFLSGGVDSCAGDSGGPLSSVEADGRIFQAGVVSWGDGCAQRNKPGVYTRLPLFRDWIKENTGV

SEQ ID NO: 366 - protein, 242 aa, Artificial Sequence
  MEMBRANE TYPE SERINE PROTEASE 1 (MT-SP1) protease domain Q38H/I41A/D60bT/F60eK/ins97aE/F97T/T98G/F99L/C122S /Q175L/Q192E
VVGGTDADEGEWPWQVSLHALGHGHACGASLISPNWLVSAAHCYIDTRGKRYSDPTQWTAFLGLHDQSQRSAPGVQERRLKRIISHPFFNDTEGLDYDIALLELEKPAEYSSMVRPISLPDASHVFPAGKAIWVTGWGHTQYGGTGALILQKGEIRVINQTTCENLLPQLITPRMMCVGFLSGGVDSCEGDSGGPLSSVEADGRIFQAGVVSWGDGCAQRNKPGVYTRLPLFRDWIKENTGV

SEQ ID NO: 367 - protein, 242 aa, Artificial Sequence
  MEMBRANE TYPE SERINE PROTEASE 1 (MT-SP1) protease domain Q38L/I41T/D60bV/F60eH/Y60gL/ins97aE/F97T/T98G/F99L /C122S/Q175L/Q192S
VVGGTDADEGEWPWQVSLHALGLGHTCGASLISPNWLVSAAHCYIDVRGHRLSDPTQWTAFLGLHDQSQRSAPGVQERRLKRIISHPFFNDTEGLDYDIALLELEKPAEYSSMVRPISLPDASHVFPAGKAIWVTGWGHTQYGGTGALILQKGEIRVINQTTCENLLPQLITPRMMCVGFLSGGVDSCSGDSGGPLSSVEADGRIFQAGVVSWGDGCAQRNKPGVYTRLPLFRDWIKENTGV

SEQ ID NO: 368 - protein, 242 aa, Artificial Sequence
  MEMBRANE TYPE SERINE PROTEASE 1 (MT-SP1) protease domain ins97aA/F97G/T98L/C122S/Q175M/Q192A/D217I/K224R
VVGGTDADEGEWPWQVSLHALGQGHICGASLISPNWLVSAAHCYIDDRGFRYSDPTQWTAFLGLHDQSQRSAPGVQERRLKRIISHPFFNDGALFDYDIALLELEKPAEYSSMVRPISLPDASHVFPAGKAIWVTGWGHTQYGGTGALILQKGEIRVINQTTCENLLPQMITPRMMCVGFLSGGVDSCAGDSGGPLSSVEADGRIFQAGVVSWGIGCAQRNRPGVYTRLPLFRDWIKENTGV

SEQ ID NO: 369 - protein, 242 aa, Artificial Sequence
  MEMBRANE TYPE SERINE PROTEASE 1 (MT-SP1) protease domain Q38H/I41A/D60bY/F60eT/ins97aE/F97T/T98G/F99L/C122S /Q175L/Q192D
VVGGTDADEGEWPWQVSLHALGHGHACGASLISPNWLVSAAHCYIDYRGTRYSDPTQWTAFLGLHDQSQRSAPGVQERRLKRIISHPFFNDTEGLDYDIALLELEKPAEYSSMVRPISLPDASHVFPAGKAIWVTGWGHTQYGGTGALILQKGEIRVINQTTCENLLPQLITPRMMCVGFLSGGVDSCDGDSGGPLSSVEADGRIFQAGVVSWGDGCAQRNKPGVYTRLPLFRDWIKENTGV

SEQ ID NO: 370 - protein, 242 aa, Artificial Sequence
  MEMBRANE TYPE SERINE PROTEASE 1 (MT-SP1) protease domain ins97aY/F97H/F99L/C122S/Q175M/Q192A/D217V
VVGGTDADEGEWPWQVSLHALGQGHICGASLISPNWLVSAAHCYIDDRGFRYSDPTQWTAFLGLHDQSQRSAPGVQERRLKRIISHPFFNDHYTLDYDIALLELEKPAEYSSMVRPISLPDASHVFPAGKAIWVTGWGHTQYGGTGALILQKGEIRVINQTTCENLLPQMITPRMMCVGFLSGGVDSCAGDSGGPLSSVEADGRIFQAGVVSWGVGCAQRNKPGVYTRLPLFRDWIKENTGV

SEQ ID NO: 371 - protein, 242 aa, Artificial Sequence
  MEMBRANE TYPE SERINE PROTEASE 1 (MT-SP1) protease domain ins97aL/F97Q/T98G/F99L/C122S/Q175M/Q192S/D217I
VVGGTDADEGEWPWQVSLHALGQGHICGASLISPNWLVSAAHCYIDDRGFRYSDPTQWTAFLGLHDQSQRSAPGVQERRLKRIISHPFFNDQLGLDYDIALLELEKPAEYSSMVRPISLPDASHVFPAGKAIWVTGWGHTQYGGTGALILQKGEIRVINQTTCENLLPQMITPRMMCVGFLSGGVDSCSGDSGGPLSSVEADGRIFQAGVVSWGIGCAQRNKPGVYTRLPLFRDWIKENTGV

SEQ ID NO: 372 - protein, 242 aa, Artificial Sequence
  MEMBRANE TYPE SERINE PROTEASE 1 (MT-SP1) protease domain ins97aY/F97G/T98V/C122S/Q175M/Q192S/D217V
VVGGTDADEGEWPWQVSLHALGQGHICGASLISPNWLVSAAHCYIDDRGFRYSDPTQWTAFLGLHDQSQRSAPGVQERRLKRIISHPFFNDGYVFDYDIALLELEKPAEYSSMVRPISLPDASHVFPAGKAIWVTGWGHTQYGGTGALILQKGEIRVINQTTCENLLPQMITPRMMCVGFLSGGVDSCSGDSGGPLSSVEADGRIFQAGVVSWGVGCAQRNKPGVYTRLPLFRDWIKENTGV

SEQ ID NO: 373 - protein, 242 aa, Artificial Sequence
  MEMBRANE TYPE SERINE PROTEASE 1 (MT-SP1) protease domain Q38Y/I41S/D60bR/F60eE/Y60gF/ins97aE/F97T/T98G/F99L /C122S/Q175L/Q192V
VVGGTDADEGEWPWQVSLHALGYGHSCGASLISPNWLVSAAHCYIDRRGERFSDPTQWTAFLGLHDQSQRSAPGVQERRLKRIISHPFFNDTEGLDYDIALLELEKPAEYSSMVRPISLPDASHVFPAGKAIWVTGWGHTQYGGTGALILQKGEIRVINQTTCENLLPQLITPRMMCVGFLSGGVDSCVGDSGGPLSSVEADGRIFQAGVVSWGDGCAQRNKPGVYTRLPLFRDWIKENTGV

SEQ ID NO: 374 - protein, 242 aa, Artificial Sequence
  MEMBRANE TYPE SERINE PROTEASE 1 (MT-SP1) protease domain Q38H/I41S/D60bT/F60eS/ins97aV/F97D/T98P/F99L/C122S /G151H/Q175L/Q192V
VVGGTDADEGEWPWQVSLHALGHGHSCGASLISPNWLVSAAHCYIDTRGSRYSDPTQWTAFLGLHDQSQRSAPGVQERRLKRIISHPFFNDDVPLDYDIALLELEKPAEYSSMVRPISLPDASHVFPAGKAIWVTGWGHTQYGGTHALILQKGEIRVINQTTCENLLPQLITPRMMCVGFLSGGVDSCVGDSGGPLSSVEADGRIFQAGVVSWGDGCAQRNKPGVYTRLPLFRDWIKENTGV

SEQ ID NO: 375 - protein, 242 aa, Artificial Sequence
  MEMBRANE TYPE SERINE PROTEASE 1 (MT-SP1) protease domain Q38H/I41S/D60bT/F60eS/Y60gW/ins97aV/F97D/T98P/F99L /C122S/G151H/Q175L/Q192V
VVGGTDADEGEWPWQVSLHALGHGHSCGASLISPNWLVSAAHCYIDTRGSRWSDPTQWTAFLGLHDQSQRSAPGVQERRLKRIISHPFFNDDVPLDYDIALLELEKPAEYSSMVRPISLPDASHVFPAGKAIWVTGWGHTQYGGTHALILQKGEIRVINQTTCENLLPQLITPRMMCVGFLSGGVDSCVGDSGGPLSSVEADGRIFQAGVVSWGDGCAQRNKPGVYTRLPLFRDWIKENTGV

SEQ ID NO: 376 - protein, 242 aa, Artificial Sequence
  MEMBRANE TYPE SERINE PROTEASE 1 (MT-SP1) protease domain Q38H/I41S/D60bT/F60eS/Y60gW/ins97aV/F97D/T98P/F99L /C122S/G151N/Q175A/Q192D
VVGGTDADEGEWPWQVSLHALGHGHSCGASLISPNWLVSAAHCYIDTRGSRWSDPTQWTAFLGLHDQSQRSAPGVQERRLKRIISHPFFNDDVPLDYDIALLELEKPAEYSSMVRPISLPDASHVFPAGKAIWVTGWGHTQYGGTNALILQKGEIRVINQTTCENLLPQAITPRMMCVGFLSGGVDSCDGDSGGPLSSVEADGRIFQAGVVSWGDGCAQRNKPGVYTRLPLFRDWIKENTGV

SEQ ID NO: 377 - protein, 242 aa, Artificial Sequence
  MEMBRANE TYPE SERINE PROTEASE 1 (MT-SP1) protease domain Q38H/I41S/D60bT/F60eS/Y60gW/ins97aV/F97D/T98P/F99L /C122S/G151N/Q175L/Q192E
VVGGTDADEGEWPWQVSLHALGHGHSCGASLISPNWLVSAAHCYIDTRGSRWSDPTQWTAFLGLHDQSQRSAPGVQERRLKRIISHPFFNDDVPLDYDIALLELEKPAEYSSMVRPISLPDASHVFPAGKAIWVTGWGHTQYGGTNALILQKGEIRVINQTTCENLLPQLITPRMMCVGFLSGGVDSCEGDSGGPLSSVEADGRIFQAGVVSWGDGCAQRNKPGVYTRLPLFRDWIKENTGV

SEQ ID NO: 378 - protein, 242 aa, Artificial Sequence
  MEMBRANE TYPE SERINE PROTEASE 1 (MT-SP1) protease domain Q38H/I41A/D60bE/F60eH/Y60gW/ins97aE/F97T/T98G/F99L /C122S/G151H/Q175L/Q192D
VVGGTDADEGEWPWQVSLHALGHGHACGASLISPNWLVSAAHCYIDERGHRWSDPTQWTAFLGLHDQSQRSAPGVQERRLKRIISHPFFNDTEGLDYDIALLELEKPAEYSSMVRPISLPDASHVFPAGKAIWVTGWGHTQYGGTHALILQKGEIRVINQTTCENLLPQLITPRMMCVGFLSGGVDSCDGDSGGPLSSVEADGRIFQAGVVSWGDGCAQRNKPGVYTRLPLFRDWIKENTGV

SEQ ID NO: 379 - protein, 242 aa, Artificial Sequence; identical to SEQ ID NO: 26
  MEMBRANE TYPE SERINE PROTEASE 1 (MT-SP1) protease domain Q38H/I41A/D60bT/F60eK/Y60gW/ins97aE/F97T/T98G/F99L /C122S/G151H/Q175L/Q192D

SEQ ID NO: 380 - protein, 242 aa, Artificial Sequence
  MEMBRANE TYPE SERINE PROTEASE 1 (MT-SP1) protease domain Q38H/I41A/D60bV/F60eI/Y60gW/ins97aE/F97T/T98G/F99L /C122S/G151H/Q175L/Q192D
VVGGTDADEGEWPWQVSLHALGHGHACGASLISPNWLVSAAHCYIDVRGIRWSDPTQWTAFLGLHDQSQRSAPGVQERRLKRIISHPFFNDTEGLDYDIALLELEKPAEYSSMVRPISLPDASHVFPAGKAIWVTGWGHTQYGGTHALILQKGEIRVINQTTCENLLPQLITPRMMCVGFLSGGVDSCDGDSGGPLSSVEADGRIFQAGVVSWGDGCAQRNKPGVYTRLPLFRDWIKENTGV

SEQ ID NO: 381 - protein, 242 aa, Artificial Sequence
  MEMBRANE TYPE SERINE PROTEASE 1 (MT-SP1) protease domain Q38E/I41S/D60bV/F60eK/Y60gW/ins97aE/F97T/T98G/F99L /C122S/G151H/Q175L/Q192D
VVGGTDADEGEWPWQVSLHALGEGHSCGASLISPNWLVSAAHCYIDVRGKRWSDPTQWTAFLGLHDQSQRSAPGVQERRLKRIISHPFFNDTEGLDYDIALLELEKPAEYSSMVRPISLPDASHVFPAGKAIWVTGWGHTQYGGTHALILQKGEIRVINQTTCENLLPQLITPRMMCVGFLSGGVDSCDGDSGGPLSSVEADGRIFQAGVVSWGDGCAQRNKPGVYTRLPLFRDWIKENTGV

SEQ ID NO: 382 - protein, 242 aa, Artificial Sequence
  MEMBRANE TYPE SERINE PROTEASE 1 (MT-SP1) protease domain Q38H/I41S/L52M/D60bG/ins97aV/F97D/T98P/F99L/M117K/ C122S/I136L/Q192G/D217A
VVGGTDADEGEWPWQVSLHALGHGHSCGASLISPNWMVSAAHCYIDGRGFRYSDPTQWTAFLGLHDQSQRSAPGVQERRLKRIISHPFFNDDVPLDYDIALLELEKPAEYSSKVRPISLPDASHVFPAGKALWVTGWGHTQYGGTGALILQKGEIRVINQTTCENLLPQQITPRMMCVGFLSGGVDSCGGDSGGPLSSVEADGRIFQAGVVSWGAGCAQRNKPGVYTRLPLFRDWIKENTGV

SEQ ID NO: 383 - protein, 242 aa, Artificial Sequence
  MEMBRANE TYPE SERINE PROTEASE 1 (MT-SP1) protease domain Q38E/I41A/D60bH/ins97aV/F97D/T98P/F99L/C122S/Q192G /Q209L/D217H
VVGGTDADEGEWPWQVSLHALGEGHACGASLISPNWLVSAAHCYIDHRGFRYSDPTQWTAFLGLHDQSQRSAPGVQERRLKRIISHPFFNDDVPLDYDIALLELEKPAEYSSMVRPISLPDASHVFPAGKAIWVTGWGHTQYGGTGALILQKGEIRVINQTTCENLLPQQITPRMMCVGFLSGGVDSCGGDSGGPLSSVEADGRIFLAGVVSWGHGCAQRNKPGVYTRLPLFRDWIKENTGV

SEQ ID NO: 384 - protein, 242 aa, Artificial Sequence
  MEMBRANE TYPE SERINE PROTEASE 1 (MT-SP1) protease domain I41S/D60bT/F93L/ins97aV/F97D/T98P/F99L/C122S/Q192G /D217H
VVGGTDADEGEWPWQVSLHALGQGHSCGASLISPNWLVSAAHCYIDTRGFRYSDPTQWTAFLGLHDQSQRSAPGVQERRLKRIISHPLFNDDVPLDYDIALLELEKPAEYSSMVRPISLPDASHVFPAGKAIWVTGWGHTQYGGTGALILQKGEIRVINQTTCENLLPQQITPRMMCVGFLSGGVDSCGGDSGGPLSSVEADGRIFQAGVVSWGHGCAQRNKPGVYTRLPLFRDWIKENTGV

SEQ ID NO: 385 - protein, 242 aa, Artificial Sequence
  MEMBRANE TYPE SERINE PROTEASE 1 (MT-SP1) protease domain I41T/D60bH/ins97aV/F97D/T98P/F99L/C122S/Q192G/D217 I
VVGGTDADEGEWPWQVSLHALGQGHTCGASLISPNWLVSAAHCYIDHRGFRYSDPTQWTAFLGLHDQSQRSAPGVQERRLKRIISHPFFNDDVPLDYDIALLELEKPAEYSSMVRPISLPDASHVFPAGKAIWVTGWGHTQYGGTGALILQKGEIRVINQTTCENLLPQQITPRMMCVGFLSGGVDSCGGDSGGPLSSVEADGRIFQAGVVSWGIGCAQRNKPGVYTRLPLFRDWIKENTGV

SEQ ID NO: 386 - protein, 242 aa, Artificial Sequence
  MEMBRANE TYPE SERINE PROTEASE 1 (MT-SP1) protease domain Q38H/I41S/D60bS/ins97aV/F97D/T98P/F99L/M117L/C122S /I136T/Q192G/D217I
VVGGTDADEGEWPWQVSLHALGHGHSCGASLISPNWLVSAAHCYIDSRGFRYSDPTQWTAFLGLHDQSQRSAPGVQERRLKRIISHPFFNDDVPLDYDIALLELEKPAEYSSLVRPISLPDASHVFPAGKATWVTGWGHTQYGGTGALILQKGEIRVINQTTCENLLPQQITPRMMCVGFLSGGVDSCGGDSGGPLSSVEADGRIFQAGVVSWGIGCAQRNKPGVYTRLPLFRDWIKENTGV

SEQ ID NO: 387 - protein, 242 aa, Artificial Sequence
  MEMBRANE TYPE SERINE PROTEASE 1 (MT-SP1) protease domain Q38R/I41T/D60bT/ins97aV/F97D/T98P/F99L/C122S/I136V /Q192G/D217N/L233Q
VVGGTDADEGEWPWQVSLHALGRGHTCGASLISPNWLVSAAHCYIDTRGFRYSDPTQWTAFLGLHDQSQRSAPGVQERRLKRIISHPFFNDDVPLDYDIALLELEKPAEYSSMVRPISLPDASHVFPAGKAVWVTGWGHTQYGGTGALILQKGEIRVINQTTCENLLPQQITPRMMCVGFLSGGVDSCGGDSGGPLSSVEADGRIFQAGVVSWGNGCAQRNKPGVYTRLPQFRDWIKENTGV

SEQ ID NO: 388 - protein, 242 aa, Artificial Sequence
  MEMBRANE TYPE SERINE PROTEASE 1 (MT-SP1) protease domain Q38H/I41A/D60bW/ins97aV/F97D/T98P/F99L/C122S/I136M /Q192G/D217N
VVGGTDADEGEWPWQVSLHALGHGHACGASLISPNWLVSAAHCYIDWRGFRYSDPTQWTAFLGLHDQSQRSAPGVQERRLKRIISHPFFNDDVPLDYDIALLELEKPAEYSSMVRPISLPDASHVFPAGKAMWVTGWGHTQYGGTGALILQKGEIRVINQTTCENLLPQQITPRMMCVGFLSGGVDSCGGDSGGPLSSVEADGRIFQAGVVSWGNGCAQRNKPGVYTRLPLFRDWIKENTGV

SEQ ID NO: 389 - protein, 242 aa, Artificial Sequence
  MEMBRANE TYPE SERINE PROTEASE 1 (MT-SP1) protease domain Q38H/I41S/P49Q/D60bS/F93L/ins97aV/F97D/T98P/F99L/C 122S/Q192G/D217Q
VVGGTDADEGEWPWQVSLHALGHGHSCGASLISQNWLVSAAHCYIDSRGFRYSDPTQWTAFLGLHDQSQRSAPGVQERRLKRIISHPLFNDDVPLDYDIALLELEKPAEYSSMVRPISLPDASHVFPAGKAIWVTGWGHTQYGGTGALILQKGEIRVINQTTCENLLPQQITPRMMCVGFLSGGVDSCGGDSGGPLSSVEADGRIFQAGVVSWGQGCAQRNKPGVYTRLPLFRDWIKENTGV

SEQ ID NO: 390 - protein, 242 aa, Artificial Sequence
  MEMBRANE TYPE SERINE PROTEASE 1 (MT-SP1) protease domain Q38H/I41S/D60bT/ins97aV/F97D/T98P/F99L/C122S/I136V /Q192G/D217S
VVGGTDADEGEWPWQVSLHALGHGHSCGASLISPNWLVSAAHCYIDTRGFRYSDPTQWTAFLGLHDQSQRSAPGVQERRLKRIISHPFFNDDVPLDYDIALLELEKPAEYSSMVRPISLPDASHVFPAGKAVWVTGWGHTQYGGTGALILQKGEIRVINQTTCENLLPQQITPRMMCVGFLSGGVDSCGGDSGGPLSSVEADGRIFQAGVVSWGSGCAQRNKPGVYTRLPLFRDWIKENTGV

SEQ ID NO: 391 - protein, 242 aa, Artificial Sequence
  MEMBRANE TYPE SERINE PROTEASE 1 (MT-SP1) protease domain Q38H/I41S/D60bS/F93L/D96Y/ins97aV/F97D/T98P/F99L/C 122S/I136F/Q192G/D217V
VVGGTDADEGEWPWQVSLHALGHGHSCGASLISPNWLVSAAHCYIDSRGFRYSDPTQWTAFLGLHDQSQRSAPGVQERRLKRIISHPLFNYDVPLDYDIALLELEKPAEYSSMVRPISLPDASHVFPAGKAFWVTGWGHTQYGGTGALILQKGEIRVINQTTCENLLPQQITPRMMCVGFLSGGVDSCGGDSGGPLSSVEADGRIFQAGVVSWGVGCAQRNKPGVYTRLPLFRDWIKENTGV

SEQ ID NO: 392 - protein, 242 aa, Artificial Sequence
  MEMBRANE TYPE SERINE PROTEASE 1 (MT-SP1) protease domain Q38H/I41T/D60bH/ins97aV/F97D/T98P/F99L/C122S/I136F /L153P/Q192G/D217Y
VVGGTDADEGEWPWQVSLHALGHGHTCGASLISPNWLVSAAHCYIDHRGFRYSDPTQWTAFLGLHDQSQRSAPGVQERRLKRIISHPFFNDDVPLDYDIALLELEKPAEYSSMVRPISLPDASHVFPAGKAFWVTGWGHTQYGGTGAPILQKGEIRVINQTTCENLLPQQITPRMMCVGFLSGGVDSCGGDSGGPLSSVEADGRIFQAGVVSWGYGCAQRNKPGVYTRLPLFRDWIKENTGV

SEQ ID NO: 393 - protein, 242 aa, Artificial Sequence
  MEMBRANE TYPE SERINE PROTEASE 1 (MT-SP1) protease domain Q38H/I41S/D60bT/F93L/ins97aV/F97D/T98P/F99L/S115N/ C122S/Q192V/F208L/D217Q
VVGGTDADEGEWPWQVSLHALGHGHSCGASLISPNWLVSAAHCYIDTRGFRYSDPTQWTAFLGLHDQSQRSAPGVQERRLKRIISHPLFNDDVPLDYDIALLELEKPAEYNSMVRPISLPDASHVFPAGKAIWVTGWGHTQYGGTGALILQKGEIRVINQTTCENLLPQQITPRMMCVGFLSGGVDSCVGDSGGPLSSVEADGRILQAGVVSWGQGCAQRNKPGVYTRLPLFRDWIKENTGV

SEQ ID NO: 394 - protein, 242 aa, Artificial Sequence
  MEMBRANE TYPE SERINE PROTEASE 1 (MT-SP1) protease domain Q38K/I41T/D60bY/ins97aV/F97D/T98P/F99L/C122S/I136T /Q192G/F208V/D217R
VVGGTDADEGEWPWQVSLHALGKGHTCGASLISPNWLVSAAHCYIDYRGFRYSDPTQWTAFLGLHDQSQRSAPGVQERRLKRIISHPFFNDDVPLDYDIALLELEKPAEYSSMVRPISLPDASHVFPAGKATWVTGWGHTQYGGTGALILQKGEIRVINQTTCENLLPQQITPRMMCVGFLSGGVDSCGGDSGGPLSSVEADGRIVQAGVVSWGRGCAQRNKPGVYTRLPLFRDWIKENTGV

SEQ ID NO: 395 - protein, 242 aa, Artificial Sequence
  MEMBRANE TYPE SERINE PROTEASE 1 (MT-SP1) protease domain Q38H/I41S/D60bS/ins97aV/F97D/T98P/F99L/C122S/I136V /Q192G/D217V
VVGGTDADEGEWPWQVSLHALGHGHSCGASLISPNWLVSAAHCYIDSRGFRYSDPTQWTAFLGLHDQSQRSAPGVQERRLKRIISHPFFNDDVPLDYDIALLELEKPAEYSSMVRPISLPDASHVFPAGKAVWVTGWGHTQYGGTGALILQKGEIRVINQTTCENLLPQQITPRMMCVGFLSGGVDSCGGDSGGPLSSVEADGRIFQAGVVSWGVGCAQRNKPGVYTRLPLFRDWIKENTGV

SEQ ID NO: 396 - protein, 242 aa, Artificial Sequence
  MEMBRANE TYPE SERINE PROTEASE 1 (MT-SP1) protease domain Q38H/I41S/D60bG/ins97aV/F97D/T98P/F99L/M117T/C122S /N164D/Q192G/D217E
VVGGTDADEGEWPWQVSLHALGHGHSCGASLISPNWLVSAAHCYIDGRGFRYSDPTQWTAFLGLHDQSQRSAPGVQERRLKRIISHPFFNDDVPLDYDIALLELEKPAEYSSTVRPISLPDASHVFPAGKAIWVTGWGHTQYGGTGALILQKGEIRVIDQTTCENLLPQQITPRMMCVGFLSGGVDSCGGDSGGPLSSVEADGRIFQAGVVSWGEGCAQRNKPGVYTRLPLFRDWIKENTGV

SEQ ID NO: 397 - protein, 242 aa, Artificial Sequence
  MEMBRANE TYPE SERINE PROTEASE 1 (MT-SP1) protease domain Q38K/I41S/D60bV/ins97aV/F97D/T98P/F99L/M117T/C122S /Q145E/Q175L/Q192G
VVGGTDADEGEWPWQVSLHALGKGHSCGASLISPNWLVSAAHCYIDVRGFRYSDPTQWTAFLGLHDQSQRSAPGVQERRLKRIISHPFFNDDVPLDYDIALLELEKPAEYSSTVRPISLPDASHVFPAGKAIWVTGWGHTEYGGTGALILQKGEIRVINQTTCENLLPQLITPRMMCVGFLSGGVDSCGGDSGGPLSSVEADGRIFQAGVVSWGDGCAQRNKPGVYTRLPLFRDWIKENTGV

SEQ ID NO: 398 - protein, 242 aa, Artificial Sequence
  MEMBRANE TYPE SERINE PROTEASE 1 (MT-SP1) protease domain Q38H/I41S/D60bT/F60eT/Y60gW/ins97aV/F97D/T98P/F99L /C122S/G151H/Q175L/Q192V
VVGGTDADEGEWPWQVSLHALGHGHSCGASLISPNWLVSAAHCYIDTRGTRWSDPTQWTAFLGLHDQSQRSAPGVQERRLKRIISHPFFNDDVPLDYDIALLELEKPAEYSSMVRPISLPDASHVFPAGKAIWVTGWGHTQYGGTHALILQKGEIRVINQTTCENLLPQLITPRMMCVGFLSGGVDSCVGDSGGPLSSVEADGRIFQAGVVSWGDGCAQRNKPGVYTRLPLFRDWIKENTGV

SEQ ID NO: 399 - protein, 242 aa, Artificial Sequence; identical to SEQ ID NO: 27
  MEMBRANE TYPE SERINE PROTEASE 1 (MT-SP1) protease domain Q38H/I41S/D60bT/F60eS/Y60gW/ins97aV/F97D/T98P/F99L /C122S/G151N/Q175L/Q192D

SEQ ID NO: 400 - protein, 242 aa, Artificial Sequence; identical to SEQ ID NO: 28
  MEMBRANE TYPE SERINE PROTEASE 1 (MT-SP1) protease domain Q38H/I41A/D60bV/F60eR/Y60gW/ins97aE/F97T/T98G/F99L /C122S/G151H/Q175L/Q192D

SEQ ID NO: 401 - protein, 242 aa, Artificial Sequence
  MEMBRANE TYPE SERINE PROTEASE 1 (MT-SP1) protease domain Q38H/I41S/L52M/D60bH/D96V/ins97aV/F97D/T98P/F99L/C 122S/T150A/Q192G/Q209L/D217T
VVGGTDADEGEWPWQVSLHALGHGHSCGASLISPNWMVSAAHCYIDHRGFRYSDPTQWTAFLGLHDQSQRSAPGVQERRLKRIISHPFFNVDVPLDYDIALLELEKPAEYSSMVRPISLPDASHVFPAGKAIWVTGWGHTQYGGAGALILQKGEIRVINQTTCENLLPQQITPRMMCVGFLSGGVDSCGGDSGGPLSSVEADGRIFLAGVVSWGTGCAQRNKPGVYTRLPLFRDWIKENTGV

SEQ ID NO: 402 - protein, 242 aa, Artificial Sequence
  MEMBRANE TYPE SERINE PROTEASE 1 (MT-SP1) protease domain I41S/D60bS/D96V/ins97aV/F97D/T98P/F99L/C122S/Q192G /F208L/D217N
VVGGTDADEGEWPWQVSLHALGQGHSCGASLISPNWLVSAAHCYIDSRGFRYSDPTQWTAFLGLHDQSQRSAPGVQERRLKRIISHPFFNVDVPLDYDIALLELEKPAEYSSMVRPISLPDASHVFPAGKAIWVTGWGHTQYGGTGALILQKGEIRVINQTTCENLLPQQITPRMMCVGFLSGGVDSCGGDSGGPLSSVEADGRILQAGVVSWGNGCAQRNKPGVYTRLPLFRDWIKENTGV

SEQ ID NO: 403 - protein, 242 aa, Artificial Sequence
  MEMBRANE TYPE SERINE PROTEASE 1 (MT-SP1) protease domain Q38H/I41S/D60bT/S90T/F97D/ins97aV/T98P/F99L/C122S/ S127N/I136F/Q192G/D217Q
VVGGTDADEGEWPWQVSLHALGHGHSCGASLISPNWLVSAAHCYIDTRGFRYSDPTQWTAFLGLHDQSQRSAPGVQERRLKRIITHPFFNDDVPLDYDIALLELEKPAEYSSMVRPISLPDANHVFPAGKAFWVTGWGHTQYGGTGALILQKGEIRVINQTTCENLLPQQITPRMMCVGFLSGGVDSCGGDSGGPLSSVEADGRIFQAGVVSWGQGCAQRNKPGVYTRLPLFRDWIKENTGV

SEQ ID NO: 404 - protein, 242 aa, Artificial Sequence
  MEMBRANE TYPE SERINE PROTEASE 1 (MT-SP1) protease domain Q38H/I41S/D60bT/F93S/ins97aV/F97D/T98P/F99L/C122S/ I136L/Q192G/D217A
VVGGTDADEGEWPWQVSLHALGHGHSCGASLISPNWLVSAAHCYIDTRGFRYSDPTQWTAFLGLHDQSQRSAPGVQERRLKRIISHPSFNDDVPLDYDIALLELEKPAEYSSMVRPISLPDASHVFPAGKALWVTGWGHTQYGGTGALILQKGEIRVINQTTCENLLPQQITPRMMCVGFLSGGVDSCGGDSGGPLSSVEADGRIFQAGVVSWGAGCAQRNKPGVYTRLPLFRDWIKENTGV

SEQ ID NO: 405 - protein, 242 aa, Artificial Sequence
  MEMBRANE TYPE SERINE PROTEASE 1 (MT-SP1) protease domain I41S/D60bH/ins97aV/F97D/T98P/F99L/C122S/I136V/Q192 G/D217N
VVGGTDADEGEWPWQVSLHALGQGHSCGASLISPNWLVSAAHCYIDHRGFRYSDPTQWTAFLGLHDQSQRSAPGVQERRLKRIISHPFFNDDVPLDYDIALLELEKPAEYSSMVRPISLPDASHVFPAGKAVWVTGWGHTQYGGTGALILQKGEIRVINQTTCENLLPQQITPRMMCVGFLSGGVDSCGGDSGGPLSSVEADGRIFQAGVVSWGNGCAQRNKPGVYTRLPLFRDWIKENTGV

SEQ ID NO: 406 - protein, 242 aa, Artificial Sequence
  MEMBRANE TYPE SERINE PROTEASE 1 (MT-SP1) protease domain L33M/Q38H/I41A/D60bA/ins97aV/F97D/T98P/F99L/C122S/ Q192G/D217N
VVGGTDADEGEWPWQVSMHALGHGHACGASLISPNWLVSAAHCYIDARGFRYSDPTQWTAFLGLHDQSQRSAPGVQERRLKRIISHPFFNDDVPLDYDIALLELEKPAEYSSMVRPISLPDASHVFPAGKAIWVTGWGHTQYGGTGALILQKGEIRVINQTTCENLLPQQITPRMMCVGFLSGGVDSCGGDSGGPLSSVEADGRIFQAGVVSWGNGCAQRNKPGVYTRLPLFRDWIKENTGV

SEQ ID NO: 407 - protein, 242 aa, Artificial Sequence
  MEMBRANE TYPE SERINE PROTEASE 1 (MT-SP1) protease domain Q38H/I41S/D60bY/D96Y/ins97aV/F97D/T98P/F99L/L106M/ C122S/I136M/Q192G/Q209L/D217T
VVGGTDADEGEWPWQVSLHALGHGHSCGASLISPNWLVSAAHCYIDYRGFRYSDPTQWTAFLGLHDQSQRSAPGVQERRLKRIISHPFFNYDVPLDYDIALMELEKPAEYSSMVRPISLPDASHVFPAGKAMWVTGWGHTQYGGTGALILQKGEIRVINQTTCENLLPQQITPRMMCVGFLSGGVDSCGGDSGGPLSSVEADGRIFLAGVVSWGTGCAQRNKPGVYTRLPLFRDWIKENTGV

SEQ ID NO: 408 - protein, 242 aa, Artificial Sequence; identical to SEQ ID NO: 29
  MEMBRANE TYPE SERINE PROTEASE 1 (MT-SP1) protease domain Q38H/I41A/D60bV/F60eR/Y60gW/D96I/ins97aN/F97Y/T98G /F99L/C122S/G151N/Q175L/Q192D

SEQ ID NO: 409 - protein, 242 aa, Artificial Sequence; identical to SEQ ID NO: 30
  MEMBRANE TYPE SERINE PROTEASE 1 (MT-SP1) protease domain Q38H/I41S/D60bT/F60eS/Y60gW/D96K/ins97aA/F97D/T98P /F99L/C122S/G151H/Q175L/Q192D

SEQ ID NO: 410 - protein, 242 aa, Artificial Sequence
  MEMBRANE TYPE SERINE PROTEASE 1 (MT-SP1) protease domain Q38H/I41T/D60bV/F60eR/Y60gW/D96I/ins97aN/F97Y/T98G /F99L/C122S/G151N/Q175L/Q192D
VVGGTDADEGEWPWQVSLHALGHGHTCGASLISPNWLVSAAHCYIDVRGRRWSDPTQWTAFLGLHDQSQRSAPGVQERRLKRIISHPFFNIYNGLDYDIALLELEKPAEYSSMVRPISLPDASHVFPAGKAIWVTGWGHTQYGGTNALILQKGEIRVINQTTCENLLPQLITPRMMCVGFLSGGVDSCDGDSGGPLSSVEADGRIFQAGVVSWGDGCAQRNKPGVYTRLPLFRDWIKENTGV

SEQ ID NO: 411 - protein, 242 aa, Artificial Sequence
  MEMBRANE TYPE SERINE PROTEASE 1 (MT-SP1) protease domain Q38H/I41A/D60bV/F60eR/Y60gW/D96Y/ins97aI/F97E/T98N /F99M/C122S/G151N/Q175L/Q192V
VVGGTDADEGEWPWQVSLHALGHGHACGASLISPNWLVSAAHCYIDVRGRRWSDPTQWTAFLGLHDQSQRSAPGVQERRLKRIISHPFFNYEINMDYDIALLELEKPAEYSSMVRPISLPDASHVFPAGKAIWVTGWGHTQYGGTNALILQKGEIRVINQTTCENLLPQLITPRMMCVGFLSGGVDSCVGDSGGPLSSVEADGRIFQAGVVSWGDGCAQRNKPGVYTRLPLFRDWIKENTGV

SEQ ID NO: 412 - protein, 242 aa, Artificial Sequence
  MEMBRANE TYPE SERINE PROTEASE 1 (MT-SP1) protease domain Q38H/I41A/D60bV/F60eR/Y60gW/D96S/ins97aR/F97A/T98S /F99L/C122S/G151N/Q175L/Q192T
VVGGTDADEGEWPWQVSLHALGHGHACGASLISPNWLVSAAHCYIDVRGRRWSDPTQWTAFLGLHDQSQRSAPGVQERRLKRIISHPFFNSARSLDYDIALLELEKPAEYSSMVRPISLPDASHVFPAGKAIWVTGWGHTQYGGTNALILQKGEIRVINQTTCENLLPQLITPRMMCVGFLSGGVDSCTGDSGGPLSSVEADGRIFQAGVVSWGDGCAQRNKPGVYTRLPLFRDWIKENTGV

SEQ ID NO: 413 - protein, 242 aa, Artificial Sequence; identical to SEQ ID NO: 31
  MEMBRANE TYPE SERINE PROTEASE 1 (MT-SP1) protease domain Q38H/I41A/D60bV/F60eR/Y60gW/D96P/ins97aN/F97W/T98G /F99L/C122S/G151N/Q175L/Q192E

SEQ ID NO: 414 - protein, 241 aa, Artificial Sequence
  MEMBRANE TYPE SERINE PROTEASE 1 (MT-SP1) protease domain Q38H/I41S/D60bT/F60eS/Y60gW/F97D/F99L/C122S/G151H/ Q175L/Q192D
VVGGTDADEGEWPWQVSLHALGHGHSCGASLISPNWLVSAAHCYIDTRGSRWSDPTQWTAFLGLHDQSQRSAPGVQERRLKRIISHPFFNDDTLDYDIALLELEKPAEYSSMVRPISLPDASHVFPAGKAIWVTGWGHTQYGGTHALILQKGEIRVINQTTCENLLPQLITPRMMCVGFLSGGVDSCDGDSGGPLSSVEADGRIFQAGVVSWGDGCAQRNKPGVYTRLPLFRDWIKENTGV

SEQ ID NO: 415 - protein, 242 aa, Artificial Sequence; identical to SEQ ID NO: 33
  MEMBRANE TYPE SERINE PROTEASE 1 (MT-SP1) protease domain Q38H/I41S/D60bT/F60eS/Y60gW/D96Y/ins97aV/F97E/T98G /F99L/C122S/G151H/Q175L/Q192D

SEQ ID NO: 416 - protein, 242 aa, Artificial Sequence
  MEMBRANE TYPE SERINE PROTEASE 1 (MT-SP1) protease domain Q38H/I41S/D60bA/Y60gG/ins97aV/F97D/T98P/F99L/C122S /H143T/G151N/Q175L/Q192A
VVGGTDADEGEWPWQVSLHALGHGHSCGASLISPNWLVSAAHCYIDARGFRGSDPTQWTAFLGLHDQSQRSAPGVQERRLKRIISHPFFNDDVPLDYDIALLELEKPAEYSSMVRPISLPDASHVFPAGKAIWVTGWGTTQYGGTNALILQKGEIRVINQTTCENLLPQLITPRMMCVGFLSGGVDSCAGDSGGPLSSVEADGRIFQAGVVSWGDGCAQRNKPGVYTRLPLFRDWIKENTGV

SEQ ID NO: 417 - protein, 242 aa, Artificial Sequence
  MEMBRANE TYPE SERINE PROTEASE 1 (MT-SP1) protease domain Q38H/I41S/D60bT/F60eH/Y60gF/ins97aV/F97D/T98P/F99L /C122S/H143R/G151N/Q175L/Q192S
VVGGTDADEGEWPWQVSLHALGHGHSCGASLISPNWLVSAAHCYIDTRGHRFSDPTQWTAFLGLHDQSQRSAPGVQERRLKRIISHPFFNDDVPLDYDIALLELEKPAEYSSMVRPISLPDASHVFPAGKAIWVTGWGRTQYGGTNALILQKGEIRVINQTTCENLLPQLITPRMMCVGFLSGGVDSCSGDSGGPLSSVEADGRIFQAGVVSWGDGCAQRNKPGVYTRLPLFRDWIKENTGV

SEQ ID NO: 418 - protein, 242 aa, Artificial Sequence
  MEMBRANE TYPE SERINE PROTEASE 1 (MT-SP1) protease domain Q38H/I41S/D60bS/F60eQ/Y60gF/ins97aV/F97D/T98P/F99L /C122S/H143R/G151N/Q175L/Q192T
VVGGTDADEGEWPWQVSLHALGHGHSCGASLISPNWLVSAAHCYIDSRGQRFSDPTQWTAFLGLHDQSQRSAPGVQERRLKRIISHPFFNDDVPLDYDIALLELEKPAEYSSMVRPISLPDASHVFPAGKAIWVTGWGRTQYGGTNALILQKGEIRVINQTTCENLLPQLITPRMMCVGFLSGGVDSCTGDSGGPLSSVEADGRIFQAGVVSWGDGCAQRNKPGVYTRLPLFRDWIKENTGV

SEQ ID NO: 419 - protein, 242 aa, Artificial Sequence
  MEMBRANE TYPE SERINE PROTEASE 1 (MT-SP1) protease domain Q38H/I41S/D60bF/F60eT/ins97aV/F97D/T98P/F99L/C122S /H143Q/G151N/Q175L/Q192G
VVGGTDADEGEWPWQVSLHALGHGHSCGASLISPNWLVSAAHCYIDFRGTRYSDPTQWTAFLGLHDQSQRSAPGVQERRLKRIISHPFFNDDVPLDYDIALLELEKPAEYSSMVRPISLPDASHVFPAGKAIWVTGWGQTQYGGTNALILQKGEIRVINQTTCENLLPQLITPRMMCVGFLSGGVDSCGGDSGGPLSSVEADGRIFQAGVVSWGDGCAQRNKPGVYTRLPLFRDWIKENTGV

SEQ ID NO: 420 - protein, 242 aa, Artificial Sequence
  MEMBRANE TYPE SERINE PROTEASE 1 (MT-SP1) protease domain Q38H/I41S/D60bF/F60eQ/Y60gF/ins97aV/F97D/T98P/F99L /C122S/H143A/G151N/Q175L/Q192A
VVGGTDADEGEWPWQVSLHALGHGHSCGASLISPNWLVSAAHCYIDFRGQRFSDPTQWTAFLGLHDQSQRSAPGVQERRLKRIISHPFFNDDVPLDYDIALLELEKPAEYSSMVRPISLPDASHVFPAGKAIWVTGWGATQYGGTNALILQKGEIRVINQTTCENLLPQLITPRMMCVGFLSGGVDSCAGDSGGPLSSVEADGRIFQAGVVSWGDGCAQRNKPGVYTRLPLFRDWIKENTGV

SEQ ID NO: 421 - protein, 242 aa, Artificial Sequence
  MEMBRANE TYPE SERINE PROTEASE 1 (MT-SP1) protease domain Q38H/I41S/D60bT/F60eT/ins97aV/F97D/T98P/F99L/C122S /H143Q/G151Q/Q175L/Q192G
VVGGTDADEGEWPWQVSLHALGHGHSCGASLISPNWLVSAAHCYIDTRGTRYSDPTQWTAFLGLHDQSQRSAPGVQERRLKRIISHPFFNDDVPLDYDIALLELEKPAEYSSMVRPISLPDASHVFPAGKAIWVTGWGQTQYGGTQALILQKGEIRVINQTTCENLLPQLITPRMMCVGFLSGGVDSCGGDSGGPLSSVEADGRIFQAGVVSWGDGCAQRNKPGVYTRLPLFRDWIKENTGV

SEQ ID NO: 422 - protein, 242 aa, Artificial Sequence
  MEMBRANE TYPE SERINE PROTEASE 1 (MT-SP1) protease domain Q38H/I41S/D60bQ/F60eQ/F97D/ins97aV/T98P/F99L/C122S /H143Q/G151Q/Q175L/Q192G
VVGGTDADEGEWPWQVSLHALGHGHSCGASLISPNWLVSAAHCYIDQRGQRYSDPTQWTAFLGLHDQSQRSAPGVQERRLKRIISHPFFNDDVPLDYDIALLELEKPAEYSSMVRPISLPDASHVFPAGKAIWVTGWGQTQYGGTQALILQKGEIRVINQTTCENLLPQLITPRMMCVGFLSGGVDSCGGDSGGPLSSVEADGRIFQAGVVSWGDGCAQRNKPGVYTRLPLFRDWIKENTGV

SEQ ID NO: 423 - protein, 242 aa, Artificial Sequence
  MEMBRANE TYPE SERINE PROTEASE 1 (MT-SP1) protease domain Q38H/I41S/D60bS/F60eQ/ins97aV/F97D/T98P/F99L/C122S /H143A/G151N/Q175L/Q192G
VVGGTDADEGEWPWQVSLHALGHGHSCGASLISPNWLVSAAHCYIDSRGQRYSDPTQWTAFLGLHDQSQRSAPGVQERRLKRIISHPFFNDDVPLDYDIALLELEKPAEYSSMVRPISLPDASHVFPAGKAIWVTGWGATQYGGTNALILQKGEIRVINQTTCENLLPQLITPRMMCVGFLSGGVDSCGGDSGGPLSSVEADGRIFQAGVVSWGDGCAQRNKPGVYTRLPLFRDWIKENTGV

SEQ ID NO: 424 - protein, 242 aa, Artificial Sequence
  MEMBRANE TYPE SERINE PROTEASE 1 (MT-SP1) protease domain Q38H/I41A/D60bV/F60eR/Y60gW/D96Q/F97E/ins97aD/T98S /F99L/C122S/G151N/Q175L/Q192R
VVGGTDADEGEWPWQVSLHALGHGHACGASLISPNWLVSAAHCYIDVRGRRWSDPTQWTAFLGLHDQSQRSAPGVQERRLKRIISHPFFNQEDSLDYDIALLELEKPAEYSSMVRPISLPDASHVFPAGKAIWVTGWGHTQYGGTNALILQKGEIRVINQTTCENLLPQLITPRMMCVGFLSGGVDSCRGDSGGPLSSVEADGRIFQAGVVSWGDGCAQRNKPGVYTRLPLFRDWIKENTGV

SEQ ID NO: 425 - protein, 242 aa, Artificial Sequence
  MEMBRANE TYPE SERINE PROTEASE 1 (MT-SP1) protease domain Q38H/I41S/D60bT/F60eS/Y60gW/D96F/F97D/ins97aE/T98S /F99L/C122S/G151H/Q175L/Q192A
VVGGTDADEGEWPWQVSLHALGHGHSCGASLISPNWLVSAAHCYIDTRGSRWSDPTQWTAFLGLHDQSQRSAPGVQERRLKRIISHPFFNFDESLDYDIALLELEKPAEYSSMVRPISLPDASHVFPAGKAIWVTGWGHTQYGGTHALILQKGEIRVINQTTCENLLPQLITPRMMCVGFLSGGVDSCAGDSGGPLSSVEADGRIFQAGVVSWGDGCAQRNKPGVYTRLPLFRDWIKENTGV

SEQ ID NO: 426 - protein, 242 aa, Artificial Sequence; identical to SEQ ID NO: 34
  MEMBRANE TYPE SERINE PROTEASE 1 (MT-SP1) protease domain Q38H/I41S/D60bT/F60eS/Y60gW/D96L/ins97aG/F97D/T98N /F99L/C122S/G151H/Q175L/Q192E

SEQ ID NO: 427 - protein, 242 aa, Artificial Sequence; identical to SEQ ID NO: 35
  MEMBRANE TYPE SERINE PROTEASE 1 (MT-SP1) protease domain Q38H/I41S/D60bT/F60eS/Y60gW/D96K/ins97aV/F97G/T98P /F99L/C122S/G151H/Q175L/Q192D

SEQ ID NO: 428 - protein, 242 aa, Artificial Sequence
  MEMBRANE TYPE SERINE PROTEASE 1 (MT-SP1) protease domain Q38H/I41A/D60bV/F60eR/Y60gW/D96I/ins97aN/F97Y/T98G /F99L/C122S/G151H/Q175L/Q192D
VVGGTDADEGEWPWQVSLHALGHGHACGASLISPNWLVSAAHCYIDVRGRRWSDPTQWTAFLGLHDQSQRSAPGVQERRLKRIISHPFFNIYNGLDYDIALLELEKPAEYSSMVRPISLPDASHVFPAGKAIWVTGWGHTQYGGTHALILQKGEIRVINQTTCENLLPQLITPRMMCVGFLSGGVDSCDGDSGGPLSSVEADGRIFQAGVVSWGDGCAQRNKPGVYTRLPLFRDWIKENTGV

SEQ ID NO: 429 - protein, 241 aa, Artificial Sequence
  MEMBRANE TYPE SERINE PROTEASE 1 (MT-SP1) protease domain Q38H/I41A/D60bV/F60eR/Y60gW/D96I/F97N/T98G/F99L/C1 22S/G151H/Q175L/Q192D
VVGGTDADEGEWPWQVSLHALGHGHACGASLISPNWLVSAAHCYIDVRGRRWSDPTQWTAFLGLHDQSQRSAPGVQERRLKRIISHPFFNINGLDYDIALLELEKPAEYSSMVRPISLPDASHVFPAGKAIWVTGWGHTQYGGTHALILQKGEIRVINQTTCENLLPQLITPRMMCVGFLSGGVDSCDGDSGGPLSSVEADGRIFQAGVVSWGDGCAQRNKPGVYTRLPLFRDWIKENTGV

SEQ ID NO: 430 - protein, 241 aa, Artificial Sequence
  MEMBRANE TYPE SERINE PROTEASE 1 (MT-SP1) protease domain Q38H/I41S/D60bT/F60eS/Y60gW/F97D/F99L/C122S/G151N/ Q175L/Q192D
VVGGTDADEGEWPWQVSLHALGHGHSCGASLISPNWLVSAAHCYIDTRGSRWSDPTQWTAFLGLHDQSQRSAPGVQERRLKRIISHPFFNDDTLDYDIALLELEKPAEYSSMVRPISLPDASHVFPAGKAIWVTGWGHTQYGGTNALILQKGEIRVINQTTCENLLPQLITPRMMCVGFLSGGVDSCDGDSGGPLSSVEADGRIFQAGVVSWGDGCAQRNKPGVYTRLPLFRDWIKENTGV

SEQ ID NO: 431 - protein, 242 aa, Artificial Sequence
  MEMBRANE TYPE SERINE PROTEASE 1 (MT-SP1) protease domain Q38H/I41S/D60bT/F60eS/Y60gW/D96Y/ins97aV/F97E/T98G /F99L/C122S/G151N/Q175L/Q192D
VVGGTDADEGEWPWQVSLHALGHGHSCGASLISPNWLVSAAHCYIDTRGSRWSDPTQWTAFLGLHDQSQRSAPGVQERRLKRIISHPFFNYEVGLDYDIALLELEKPAEYSSMVRPISLPDASHVFPAGKAIWVTGWGHTQYGGTNALILQKGEIRVINQTTCENLLPQLITPRMMCVGFLSGGVDSCDGDSGGPLSSVEADGRIFQAGVVSWGDGCAQRNKPGVYTRLPLFRDWIKENTGV

SEQ ID NO: 432 - protein, 242 aa, Artificial Sequence
  MEMBRANE TYPE SERINE PROTEASE 1 (MT-SP1) protease domain Q38H/I41A/D60bV/F60eR/Y60gW/D96P/ins97aN/F97W/T98G /F99L/C122S/G151H/Q175L/Q192E
VVGGTDADEGEWPWQVSLHALGHGHACGASLISPNWLVSAAHCYIDVRGRRWSDPTQWTAFLGLHDQSQRSAPGVQERRLKRIISHPFFNPWNGLDYDIALLELEKPAEYSSMVRPISLPDASHVFPAGKAIWVTGWGHTQYGGTHALILQKGEIRVINQTTCENLLPQLITPRMMCVGFLSGGVDSCEGDSGGPLSSVEADGRIFQAGVVSWGDGCAQRNKPGVYTRLPLFRDWIKENTGV

SEQ ID NO: 433 - protein, 242 aa, Artificial Sequence
  MEMBRANE TYPE SERINE PROTEASE 1 (MT-SP1) protease domain Q38H/I41A/D60bV/F60eR/Y60gW/D96P/ins97aN/F97W/T98G /F99L/C122S/G151N/Q175L/Q192D
VVGGTDADEGEWPWQVSLHALGHGHACGASLISPNWLVSAAHCYIDVRGRRWSDPTQWTAFLGLHDQSQRSAPGVQERRLKRIISHPFFNPWNGLDYDIALLELEKPAEYSSMVRPISLPDASHVFPAGKAIWVTGWGHTQYGGTNALILQKGEIRVINQTTCENLLPQLITPRMMCVGFLSGGVDSCDGDSGGPLSSVEADGRIFQAGVVSWGDGCAQRNKPGVYTRLPLFRDWIKENTGV

SEQ ID NO: 434 - protein, 242 aa, Artificial Sequence
  MEMBRANE TYPE SERINE PROTEASE 1 (MT-SP1) protease domain Q38H/I41A/D60bV/F60eR/Y60gW/D96P/ins97aN/F97W/T98G /F99L/C122S/G151H/Q175L/Q192D
VVGGTDADEGEWPWQVSLHALGHGHACGASLISPNWLVSAAHCYIDVRGRRWSDPTQWTAFLGLHDQSQRSAPGVQERRLKRIISHPFFNPWNGLDYDIALLELEKPAEYSSMVRPISLPDASHVFPAGKAIWVTGWGHTQYGGTHALILQKGEIRVINQTTCENLLPQLITPRMMCVGFLSGGVDSCDGDSGGPLSSVEADGRIFQAGVVSWGDGCAQRNKPGVYTRLPLFRDWIKENTGV

SEQ ID NO: 435 - protein, 241 aa, Artificial Sequence
  MEMBRANE TYPE SERINE PROTEASE 1 (MT-SP1) protease domain Q38H/I41A/D60bV/F60eR/Y60gW/F97D/F99L/C122S/G151H/ Q175L/Q192D
VVGGTDADEGEWPWQVSLHALGHGHACGASLISPNWLVSAAHCYIDVRGRRWSDPTQWTAFLGLHDQSQRSAPGVQERRLKRIISHPFFNDDTLDYDIALLELEKPAEYSSMVRPISLPDASHVFPAGKAIWVTGWGHTQYGGTHALILQKGEIRVINQTTCENLLPQLITPRMMCVGFLSGGVDSCDGDSGGPLSSVEADGRIFQAGVVSWGDGCAQRNKPGVYTRLPLFRDWIKENTGV

SEQ ID NO: 436 - protein, 241 aa, Artificial Sequence
  MEMBRANE TYPE SERINE PROTEASE 1 (MT-SP1) protease domain Q38H/I41S/D60bT/F60eS/Y60gW/D96I/F97N/T98G/F99L/C1 22S/G151N/Q175L/Q192D
VVGGTDADEGEWPWQVSLHALGHGHSCGASLISPNWLVSAAHCYIDTRGSRWSDPTQWTAFLGLHDQSQRSAPGVQERRLKRIISHPFFNINGLDYDIALLELEKPAEYSSMVRPISLPDASHVFPAGKAIWVTGWGHTQYGGTNALILQKGEIRVINQTTCENLLPQLITPRMMCVGFLSGGVDSCDGDSGGPLSSVEADGRIFQAGVVSWGDGCAQRNKPGVYTRLPLFRDWIKENTGV

SEQ ID NO: 437 - protein, 241 aa, Artificial Sequence
  MEMBRANE TYPE SERINE PROTEASE 1 (MT-SP1) protease domain Q38H/I41A/D60bV/F60eR/Y60gW/F97D/F99L/C122S/G151N/ Q175L/Q192D
VVGGTDADEGEWPWQVSLHALGHGHACGASLISPNWLVSAAHCYIDVRGRRWSDPTQWTAFLGLHDQSQRSAPGVQERRLKRIISHPFFNDDTLDYDIALLELEKPAEYSSMVRPISLPDASHVFPAGKAIWVTGWGHTQYGGTNALILQKGEIRVINQTTCENLLPQLITPRMMCVGFLSGGVDSCDGDSGGPLSSVEADGRIFQAGVVSWGDGCAQRNKPGVYTRLPLFRDWIKENTGV

SEQ ID NO: 438 - protein, 242 aa, Artificial Sequence
  MEMBRANE TYPE SERINE PROTEASE 1 (MT-SP1) protease domain I41S/D60bT/F60eS/Y60gW/ins97aV/F97D/T98P/F99L/C122 S/G151H/Q175L/Q192E
VVGGTDADEGEWPWQVSLHALGQGHSCGASLISPNWLVSAAHCYIDTRGSRWSDPTQWTAFLGLHDQSQRSAPGVQERRLKRIISHPFFNDDVPLDYDIALLELEKPAEYSSMVRPISLPDASHVFPAGKAIWVTGWGHTQYGGTHALILQKGEIRVINQTTCENLLPQLITPRMMCVGFLSGGVDSCEGDSGGPLSSVEADGRIFQAGVVSWGDGCAQRNKPGVYTRLPLFRDWIKENTGV

SEQ ID NO: 439 - protein, 242 aa, Artificial Sequence
  MEMBRANE TYPE SERINE PROTEASE 1 (MT-SP1) protease domain Q38H/D60bT/F60eS/Y60gW/ins97aV/F97D/T98P/F99L/C122 S/G151H/Q175L/Q192E
VVGGTDADEGEWPWQVSLHALGHGHICGASLISPNWLVSAAHCYIDTRGSRWSDPTQWTAFLGLHDQSQRSAPGVQERRLKRIISHPFFNDDVPLDYDIALLELEKPAEYSSMVRPISLPDASHVFPAGKAIWVTGWGHTQYGGTHALILQKGEIRVINQTTCENLLPQLITPRMMCVGFLSGGVDSCEGDSGGPLSSVEADGRIFQAGVVSWGDGCAQRNKPGVYTRLPLFRDWIKENTGV

SEQ ID NO: 440 - protein, 242 aa, Artificial Sequence
  MEMBRANE TYPE SERINE PROTEASE 1 (MT-SP1) protease domain Q38H/I41S/F60eS/Y60gW/ins97aV/F97D/T98P/F99L/C122S /G151H/Q175L/Q192E
VVGGTDADEGEWPWQVSLHALGHGHSCGASLISPNWLVSAAHCYIDDRGSRWSDPTQWTAFLGLHDQSQRSAPGVQERRLKRIISHPFFNDDVPLDYDIALLELEKPAEYSSMVRPISLPDASHVFPAGKAIWVTGWGHTQYGGTHALILQKGEIRVINQTTCENLLPQLITPRMMCVGFLSGGVDSCEGDSGGPLSSVEADGRIFQAGVVSWGDGCAQRNKPGVYTRLPLFRDWIKENTGV

SEQ ID NO: 441 - protein, 242 aa, Artificial Sequence
  MEMBRANE TYPE SERINE PROTEASE 1 (MT-SP1) protease domain Q38H/I41S/D60bT/F60eS/Y60gW/ins97aV/T98P/F99L/C122 S/G151H/Q175L/Q192E
VVGGTDADEGEWPWQVSLHALGHGHSCGASLISPNWLVSAAHCYIDTRGSRWSDPTQWTAFLGLHDQSQRSAPGVQERRLKRIISHPFFNDFVPLDYDIALLELEKPAEYSSMVRPISLPDASHVFPAGKAIWVTGWGHTQYGGTHALILQKGEIRVINQTTCENLLPQLITPRMMCVGFLSGGVDSCEGDSGGPLSSVEADGRIFQAGVVSWGDGCAQRNKPGVYTRLPLFRDWIKENTGV

SEQ ID NO: 442 - protein, 241 aa, Artificial Sequence
  MEMBRANE TYPE SERINE PROTEASE 1 (MT-SP1) protease domain Q38H/I41S/D60bT/F60eS/Y60gW/F97D/T98P/F99L/C122S/G 151H/Q175L/Q192E
VVGGTDADEGEWPWQVSLHALGHGHSCGASLISPNWLVSAAHCYIDTRGSRWSDPTQWTAFLGLHDQSQRSAPGVQERRLKRIISHPFFNDDPLDYDIALLELEKPAEYSSMVRPISLPDASHVFPAGKAIWVTGWGHTQYGGTHALILQKGEIRVINQTTCENLLPQLITPRMMCVGFLSGGVDSCEGDSGGPLSSVEADGRIFQAGVVSWGDGCAQRNKPGVYTRLPLFRDWIKENTGV

SEQ ID NO: 443 - protein, 242 aa, Artificial Sequence
  MEMBRANE TYPE SERINE PROTEASE 1 (MT-SP1) protease domain Q38H/I41S/D60bT/F60eS/Y60gW/ins97aV/F97D/F99L/C122 S/G151H/Q175L/Q192E
VVGGTDADEGEWPWQVSLHALGHGHSCGASLISPNWLVSAAHCYIDTRGSRWSDPTQWTAFLGLHDQSQRSAPGVQERRLKRIISHPFFNDDVTLDYDIALLELEKPAEYSSMVRPISLPDASHVFPAGKAIWVTGWGHTQYGGTHALILQKGEIRVINQTTCENLLPQLITPRMMCVGFLSGGVDSCEGDSGGPLSSVEADGRIFQAGVVSWGDGCAQRNKPGVYTRLPLFRDWIKENTGV

SEQ ID NO: 444 - protein, 242 aa, Artificial Sequence
  MEMBRANE TYPE SERINE PROTEASE 1 (MT-SP1) protease domain Q38H/I41S/D60bT/F60eS/Y60gW/ins97aV/F97D/T98P/C122 S/G151H/Q175L/Q192E
VVGGTDADEGEWPWQVSLHALGHGHSCGASLISPNWLVSAAHCYIDTRGSRWSDPTQWTAFLGLHDQSQRSAPGVQERRLKRIISHPFFNDDVPFDYDIALLELEKPAEYSSMVRPISLPDASHVFPAGKAIWVTGWGHTQYGGTHALILQKGEIRVINQTTCENLLPQLITPRMMCVGFLSGGVDSCEGDSGGPLSSVEADGRIFQAGVVSWGDGCAQRNKPGVYTRLPLFRDWIKENTGV

SEQ ID NO: 445 - protein, 242 aa, Artificial Sequence
  MEMBRANE TYPE SERINE PROTEASE 1 (MT-SP1) protease domain Q38H/I41S/D60bT/F60eS/Y60gW/ins97aV/F97D/T98P/F99L /C122S/Q175L/Q192E
VVGGTDADEGEWPWQVSLHALGHGHSCGASLISPNWLVSAAHCYIDTRGSRWSDPTQWTAFLGLHDQSQRSAPGVQERRLKRIISHPFFNDDVPLDYDIALLELEKPAEYSSMVRPISLPDASHVFPAGKAIWVTGWGHTQYGGTGALILQKGEIRVINQTTCENLLPQLITPRMMCVGFLSGGVDSCEGDSGGPLSSVEADGRIFQAGVVSWGDGCAQRNKPGVYTRLPLFRDWIKENTGV

SEQ ID NO: 446 - protein, 242 aa, Artificial Sequence
  MEMBRANE TYPE SERINE PROTEASE 1 (MT-SP1) protease domain Q38H/I41S/D60bT/F60eS/Y60gW/F97D/ins97aV/T98P/F99L /C122S/G151H/Q192E
VVGGTDADEGEWPWQVSLHALGHGHSCGASLISPNWLVSAAHCYIDTRGSRWSDPTQWTAFLGLHDQSQRSAPGVQERRLKRIISHPFFNDDVPLDYDIALLELEKPAEYSSMVRPISLPDASHVFPAGKAIWVTGWGHTQYGGTHALILQKGEIRVINQTTCENLLPQQITPRMMCVGFLSGGVDSCEGDSGGPLSSVEADGRIFQAGVVSWGDGCAQRNKPGVYTRLPLFRDWIKENTGV

SEQ ID NO: 447 - protein, 242 aa, Artificial Sequence
  MEMBRANE TYPE SERINE PROTEASE 1 (MT-SP1) protease domain Q38H/I41S/D60bT/F60eS/Y60gW/ins97aV/F97D/T98P/F99L /C122S/G151H/Q175L
VVGGTDADEGEWPWQVSLHALGHGHSCGASLISPNWLVSAAHCYIDTRGSRWSDPTQWTAFLGLHDQSQRSAPGVQERRLKRIISHPFFNDDVPLDYDIALLELEKPAEYSSMVRPISLPDASHVFPAGKAIWVTGWGHTQYGGTHALILQKGEIRVINQTTCENLLPQLITPRMMCVGFLSGGVDSCQGDSGGPLSSVEADGRIFQAGVVSWGDGCAQRNKPGVYTRLPLFRDWIKENTGV

SEQ ID NO: 448 - protein, 242 aa, Artificial Sequence
  MEMBRANE TYPE SERINE PROTEASE 1 (MT-SP1) protease domain Q38H/I41S/D60bT/F60eS/Y60gW/F97D/ins97aA/T98P/F99L /C122S/G151H/Q175L/Q192E
VVGGTDADEGEWPWQVSLHALGHGHSCGASLISPNWLVSAAHCYIDTRGSRWSDPTQWTAFLGLHDQSQRSAPGVQERRLKRIISHPFFNDDAPLDYDIALLELEKPAEYSSMVRPISLPDASHVFPAGKAIWVTGWGHTQYGGTHALILQKGEIRVINQTTCENLLPQLITPRMMCVGFLSGGVDSCEGDSGGPLSSVEADGRIFQAGVVSWGDGCAQRNKPGVYTRLPLFRDWIKENTGV

SEQ ID NO: 449 - protein, 242 aa, Artificial Sequence
  MEMBRANE TYPE SERINE PROTEASE 1 (MT-SP1) protease domain Q38H/I41S/D60bT/Y60gW/ins97aV/F97D/T98P/F99L/C122S /G151H/Q175L/Q192E
VVGGTDADEGEWPWQVSLHALGHGHSCGASLISPNWLVSAAHCYIDTRGFRWSDPTQWTAFLGLHDQSQRSAPGVQERRLKRIISHPFFNDDVPLDYDIALLELEKPAEYSSMVRPISLPDASHVFPAGKAIWVTGWGHTQYGGTHALILQKGEIRVINQTTCENLLPQLITPRMMCVGFLSGGVDSCEGDSGGPLSSVEADGRIFQAGVVSWGDGCAQRNKPGVYTRLPLFRDWIKENTGV

SEQ ID NO: 450 - protein, 241 aa, Artificial Sequence
  MEMBRANE TYPE SERINE PROTEASE 1 (MT-SP1) protease domain Q38H/I41S/D60bT/F60eG/Y60gW/D96V/F97N/T98G/F99L/C1 22S/G151N/Q175L/Q192D
VVGGTDADEGEWPWQVSLHALGHGHSCGASLISPNWLVSAAHCYIDTRGGRWSDPTQWTAFLGLHDQSQRSAPGVQERRLKRIISHPFFNVNGLDYDIALLELEKPAEYSSMVRPISLPDASHVFPAGKAIWVTGWGHTQYGGTNALILQKGEIRVINQTTCENLLPQLITPRMMCVGFLSGGVDSCDGDSGGPLSSVEADGRIFQAGVVSWGDGCAQRNKPGVYTRLPLFRDWIKENTGV

SEQ ID NO: 451 - protein, 241 aa, Artificial Sequence
  MEMBRANE TYPE SERINE PROTEASE 1 (MT-SP1) protease domain Q38K/I41G/F60eG/Y60gW/D96P/F97N/T98G/F99L/C122S/G1 51N/Q175L/Q192D
VVGGTDADEGEWPWQVSLHALGKGHGCGASLISPNWLVSAAHCYIDDRGGRWSDPTQWTAFLGLHDQSQRSAPGVQERRLKRIISHPFFNPNGLDYDIALLELEKPAEYSSMVRPISLPDASHVFPAGKAIWVTGWGHTQYGGTNALILQKGEIRVINQTTCENLLPQLITPRMMCVGFLSGGVDSCDGDSGGPLSSVEADGRIFQAGVVSWGDGCAQRNKPGVYTRLPLFRDWIKENTGV

SEQ ID NO: 452 - protein, 241 aa, Artificial Sequence
  MEMBRANE TYPE SERINE PROTEASE 1 (MT-SP1) protease domain Q38Y/I41E/D60bS/F60eV/Y60gF/D96W/F97N/T98G/F99L/C1 22S/G151N/Q175L/Q192D
VVGGTDADEGEWPWQVSLHALGYGHECGASLISPNWLVSAAHCYIDSRGVRFSDPTQWTAFLGLHDQSQRSAPGVQERRLKRIISHPFFNWNGLDYDIALLELEKPAEYSSMVRPISLPDASHVFPAGKAIWVTGWGHTQYGGTNALILQKGEIRVINQTTCENLLPQLITPRMMCVGFLSGGVDSCDGDSGGPLSSVEADGRIFQAGVVSWGDGCAQRNKPGVYTRLPLFRDWIKENTGV

SEQ ID NO: 453 - protein, 241 aa, Artificial Sequence
  MEMBRANE TYPE SERINE PROTEASE 1 (MT-SP1) protease domain Q38H/I41S/D60bT/F60eG/D96Y/F97N/T98G/F99L/C122S/G1 51N/Q175L/Q192D
VVGGTDADEGEWPWQVSLHALGHGHSCGASLISPNWLVSAAHCYIDTRGGRYSDPTQWTAFLGLHDQSQRSAPGVQERRLKRIISHPFFNYNGLDYDIALLELEKPAEYSSMVRPISLPDASHVFPAGKAIWVTGWGHTQYGGTNALILQKGEIRVINQTTCENLLPQLITPRMMCVGFLSGGVDSCDGDSGGPLSSVEADGRIFQAGVVSWGDGCAQRNKPGVYTRLPLFRDWIKENTGV

SEQ ID NO: 454 - protein, 241 aa, Artificial Sequence
  MEMBRANE TYPE SERINE PROTEASE 1 (MT-SP1) protease domain Q38V/I41G/F60eG/Y60gW/D96P/F97N/T98G/F99L/C122S/G1 51N/Q175L/Q192D
VVGGTDADEGEWPWQVSLHALGVGHGCGASLISPNWLVSAAHCYIDDRGGRWSDPTQWTAFLGLHDQSQRSAPGVQERRLKRIISHPFFNPNGLDYDIALLELEKPAEYSSMVRPISLPDASHVFPAGKAIWVTGWGHTQYGGTNALILQKGEIRVINQTTCENLLPQLITPRMMCVGFLSGGVDSCDGDSGGPLSSVEADGRIFQAGVVSWGDGCAQRNKPGVYTRLPLFRDWIKENTGV

SEQ ID NO: 455 - protein, 241 aa, Artificial Sequence
  MEMBRANE TYPE SERINE PROTEASE 1 (MT-SP1) protease domain Q38Y/I41A/D60bT/F60eG/Y60gW/D96V/F97N/T98G/F99L/C1 22S/G151H/Q175L/Q192D
VVGGTDADEGEWPWQVSLHALGYGHACGASLISPNWLVSAAHCYIDTRGGRWSDPTQWTAFLGLHDQSQRSAPGVQERRLKRIISHPFFNVNGLDYDIALLELEKPAEYSSMVRPISLPDASHVFPAGKAIWVTGWGHTQYGGTHALILQKGEIRVINQTTCENLLPQLITPRMMCVGFLSGGVDSCDGDSGGPLSSVEADGRIFQAGVVSWGDGCAQRNKPGVYTRLPLFRDWIKENTGV

SEQ ID NO: 456 - protein, 241 aa, Artificial Sequence
  MEMBRANE TYPE SERINE PROTEASE 1 (MT-SP1) protease domain Q38H/I41S/D60bT/F60eG/D96P/F97N/T98G/F99L/C122S/G1 51Q/Q175L/Q192D
VVGGTDADEGEWPWQVSLHALGHGHSCGASLISPNWLVSAAHCYIDTRGGRYSDPTQWTAFLGLHDQSQRSAPGVQERRLKRIISHPFFNPNGLDYDIALLELEKPAEYSSMVRPISLPDASHVFPAGKAIWVTGWGHTQYGGTQALILQKGEIRVINQTTCENLLPQLITPRMMCVGFLSGGVDSCDGDSGGPLSSVEADGRIFQAGVVSWGDGCAQRNKPGVYTRLPLFRDWIKENTGV

SEQ ID NO: 457 - protein, 241 aa, Artificial Sequence
  MEMBRANE TYPE SERINE PROTEASE 1 (MT-SP1) protease domain Q38K/I41G/D60bT/F60eG/Y60gW/D96P/F97N/T98G/F99L/C1 22S/G151N/Q175L/Q192D
VVGGTDADEGEWPWQVSLHALGKGHGCGASLISPNWLVSAAHCYIDTRGGRWSDPTQWTAFLGLHDQSQRSAPGVQERRLKRIISHPFFNPNGLDYDIALLELEKPAEYSSMVRPISLPDASHVFPAGKAIWVTGWGHTQYGGTNALILQKGEIRVINQTTCENLLPQLITPRMMCVGFLSGGVDSCDGDSGGPLSSVEADGRIFQAGVVSWGDGCAQRNKPGVYTRLPLFRDWIKENTGV

SEQ ID NO: 458 - protein, 241 aa, Artificial Sequence
  MEMBRANE TYPE SERINE PROTEASE 1 (MT-SP1) protease domain Q38K/I41G/D60bT/F60eG/Y60gW/D96L/F97N/T98G/F99L/C1 22S/G151N/Q175L/Q192D
VVGGTDADEGEWPWQVSLHALGKGHGCGASLISPNWLVSAAHCYIDTRGGRWSDPTQWTAFLGLHDQSQRSAPGVQERRLKRIISHPFFNLNGLDYDIALLELEKPAEYSSMVRPISLPDASHVFPAGKAIWVTGWGHTQYGGTNALILQKGEIRVINQTTCENLLPQLITPRMMCVGFLSGGVDSCDGDSGGPLSSVEADGRIFQAGVVSWGDGCAQRNKPGVYTRLPLFRDWIKENTGV

SEQ ID NO: 459 - protein, 241 aa, Artificial Sequence
  MEMBRANE TYPE SERINE PROTEASE 1 (MT-SP1) protease domain Q38E/I41S/D60bV/F60eK/Y60gW/D96P/F97N/T98G/F99L/C1 22S/G151N/Q175L/Q192D
VVGGTDADEGEWPWQVSLHALGEGHSCGASLISPNWLVSAAHCYIDVRGKRWSDPTQWTAFLGLHDQSQRSAPGVQERRLKRIISHPFFNPNGLDYDIALLELEKPAEYSSMVRPISLPDASHVFPAGKAIWVTGWGHTQYGGTNALILQKGEIRVINQTTCENLLPQLITPRMMCVGFLSGGVDSCDGDSGGPLSSVEADGRIFQAGVVSWGDGCAQRNKPGVYTRLPLFRDWIKENTGV

SEQ ID NO: 460 - protein, 241 aa, Artificial Sequence
  MEMBRANE TYPE SERINE PROTEASE 1 (MT-SP1) protease domain Q38E/I41S/D60bW/F60eG/D96M/F97N/T98G/F99L/C122S/G1 51N/Q175L/Q192D
VVGGTDADEGEWPWQVSLHALGEGHSCGASLISPNWLVSAAHCYIDWRGGRYSDPTQWTAFLGLHDQSQRSAPGVQERRLKRIISHPFFNMNGLDYDIALLELEKPAEYSSMVRPISLPDASHVFPAGKAIWVTGWGHTQYGGTNALILQKGEIRVINQTTCENLLPQLITPRMMCVGFLSGGVDSCDGDSGGPLSSVEADGRIFQAGVVSWGDGCAQRNKPGVYTRLPLFRDWIKENTGV

SEQ ID NO: 461 - protein, 241 aa, Artificial Sequence
  MEMBRANE TYPE SERINE PROTEASE 1 (MT-SP1) protease domain Q38M/I41S/F60eH/Y60gW/D96Y/F97N/T98G/F99L/C122S/G1 51N/Q175L/Q192D
VVGGTDADEGEWPWQVSLHALGMGHSCGASLISPNWLVSAAHCYIDDRGHRWSDPTQWTAFLGLHDQSQRSAPGVQERRLKRIISHPFFNYNGLDYDIALLELEKPAEYSSMVRPISLPDASHVFPAGKAIWVTGWGHTQYGGTNALILQKGEIRVINQTTCENLLPQLITPRMMCVGFLSGGVDSCDGDSGGPLSSVEADGRIFQAGVVSWGDGCAQRNKPGVYTRLPLFRDWIKENTGV

SEQ ID NO: 462 - protein, 242 aa, Artificial Sequence
  MEMBRANE TYPE SERINE PROTEASE 1 (MT-SP1) protease domain Q38H/I41A/D60bV/F60eR/Y60gW/D96F/F97D/ins97aE/T98G /F99M/C122S/G151N/Q175L/Q192R
VVGGTDADEGEWPWQVSLHALGHGHACGASLISPNWLVSAAHCYIDVRGRRWSDPTQWTAFLGLHDQSQRSAPGVQERRLKRIISHPFFNFDEGMDYDIALLELEKPAEYSSMVRPISLPDASHVFPAGKAIWVTGWGHTQYGGTNALILQKGEIRVINQTTCENLLPQLITPRMMCVGFLSGGVDSCRGDSGGPLSSVEADGRIFQAGVVSWGDGCAQRNKPGVYTRLPLFRDWIKENTGV

SEQ ID NO: 463 - protein, 242 aa, Artificial Sequence
  MEMBRANE TYPE SERINE PROTEASE 1 (MT-SP1) protease domain Q38H/I41A/D60bV/F60eR/Y60gW/D96F/F97E/ins97aT/T98G /F99M/C122S/G151N/Q175L/Q192G
VVGGTDADEGEWPWQVSLHALGHGHACGASLISPNWLVSAAHCYIDVRGRRWSDPTQWTAFLGLHDQSQRSAPGVQERRLKRIISHPFFNFETGMDYDIALLELEKPAEYSSMVRPISLPDASHVFPAGKAIWVTGWGHTQYGGTNALILQKGEIRVINQTTCENLLPQLITPRMMCVGFLSGGVDSCGGDSGGPLSSVEADGRIFQAGVVSWGDGCAQRNKPGVYTRLPLFRDWIKENTGV

SEQ ID NO: 464 - protein, 242 aa, Artificial Sequence
  MEMBRANE TYPE SERINE PROTEASE 1 (MT-SP1) protease domain Q38H/I41A/D60bV/F60eR/Y60gW/D96F/F97E/ins97aS/T98G /F99M/C122S/G151N/Q175L/Q192G
VVGGTDADEGEWPWQVSLHALGHGHACGASLISPNWLVSAAHCYIDVRGRRWSDPTQWTAFLGLHDQSQRSAPGVQERRLKRIISHPFFNFESGMDYDIALLELEKPAEYSSMVRPISLPDASHVFPAGKAIWVTGWGHTQYGGTNALILQKGEIRVINQTTCENLLPQLITPRMMCVGFLSGGVDSCGGDSGGPLSSVEADGRIFQAGVVSWGDGCAQRNKPGVYTRLPLFRDWIKENTGV

SEQ ID NO: 465 - protein, 242 aa, Artificial Sequence
  MEMBRANE TYPE SERINE PROTEASE 1 (MT-SP1) protease domain Q38H/I41A/D60bV/F60eR/Y60gW/D96W/F97D/ins97aD/T98G /F99L/C122S/G151N/Q175L/Q192G
VVGGTDADEGEWPWQVSLHALGHGHACGASLISPNWLVSAAHCYIDVRGRRWSDPTQWTAFLGLHDQSQRSAPGVQERRLKRIISHPFFNWDDGLDYDIALLELEKPAEYSSMVRPISLPDASHVFPAGKAIWVTGWGHTQYGGTNALILQKGEIRVINQTTCENLLPQLITPRMMCVGFLSGGVDSCGGDSGGPLSSVEADGRIFQAGVVSWGDGCAQRNKPGVYTRLPLFRDWIKENTGV

SEQ ID NO: 466 - protein, 242 aa, Artificial Sequence
  MEMBRANE TYPE SERINE PROTEASE 1 (MT-SP1) protease domain Q38H/I41A/D60bV/F60eR/Y60gW/D96F/F97Y/ins97aE/T98G /F99M/C122S/G151N/Q175L/Q192R
VVGGTDADEGEWPWQVSLHALGHGHACGASLISPNWLVSAAHCYIDVRGRRWSDPTQWTAFLGLHDQSQRSAPGVQERRLKRIISHPFFNFYEGMDYDIALLELEKPAEYSSMVRPISLPDASHVFPAGKAIWVTGWGHTQYGGTNALILQKGEIRVINQTTCENLLPQLITPRMMCVGFLSGGVDSCRGDSGGPLSSVEADGRIFQAGVVSWGDGCAQRNKPGVYTRLPLFRDWIKENTGV

SEQ ID NO: 467 - protein, 242 aa, Artificial Sequence
  MEMBRANE TYPE SERINE PROTEASE 1 (MT-SP1) protease domain Q38H/I41A/D60bV/F60eR/Y60gW/D96W/F97D/ins97aT/T98G /F99L/C122S/G151N/Q175L/Q192G
VVGGTDADEGEWPWQVSLHALGHGHACGASLISPNWLVSAAHCYIDVRGRRWSDPTQWTAFLGLHDQSQRSAPGVQERRLKRIISHPFFNWDTGLDYDIALLELEKPAEYSSMVRPISLPDASHVFPAGKAIWVTGWGHTQYGGTNALILQKGEIRVINQTTCENLLPQLITPRMMCVGFLSGGVDSCGGDSGGPLSSVEADGRIFQAGVVSWGDGCAQRNKPGVYTRLPLFRDWIKENTGV

SEQ ID NO: 468 - protein, 241 aa, Artificial Sequence
  MEMBRANE TYPE SERINE PROTEASE 1 (MT-SP1) protease domain Q38H/I41S/D60bT/F60eK/Y60gF/D96M/F97N/T98G/F99L/C1 22S/G151N/Q175L/Q192D
VVGGTDADEGEWPWQVSLHALGHGHSCGASLISPNWLVSAAHCYIDTRGKRFSDPTQWTAFLGLHDQSQRSAPGVQERRLKRIISHPFFNMNGLDYDIALLELEKPAEYSSMVRPISLPDASHVFPAGKAIWVTGWGHTQYGGTNALILQKGEIRVINQTTCENLLPQLITPRMMCVGFLSGGVDSCDGDSGGPLSSVEADGRIFQAGVVSWGDGCAQRNKPGVYTRLPLFRDWIKENTGV

SEQ ID NO: 469 - protein, 242 aa, Artificial Sequence
  MEMBRANE TYPE SERINE PROTEASE 1 (MT-SP1) protease domain Q38H/I41A/D60bV/F60eR/Y60gW/D96F/F97S/ins97aH/T98G /F99L/C122S/G151N/Q175L/Q192G
VVGGTDADEGEWPWQVSLHALGHGHACGASLISPNWLVSAAHCYIDVRGRRWSDPTQWTAFLGLHDQSQRSAPGVQERRLKRIISHPFFNFSHGLDYDIALLELEKPAEYSSMVRPISLPDASHVFPAGKAIWVTGWGHTQYGGTNALILQKGEIRVINQTTCENLLPQLITPRMMCVGFLSGGVDSCGGDSGGPLSSVEADGRIFQAGVVSWGDGCAQRNKPGVYTRLPLFRDWIKENTGV

SEQ ID NO: 470 - protein, 242 aa, Artificial Sequence
  MEMBRANE TYPE SERINE PROTEASE 1 (MT-SP1) protease domain Q38H/I41A/D60bV/F60eR/Y60gW/D96F/F97Y/ins97aN/T98G /F99M/C122S/G151N/Q175L/Q192G
VVGGTDADEGEWPWQVSLHALGHGHACGASLISPNWLVSAAHCYIDVRGRRWSDPTQWTAFLGLHDQSQRSAPGVQERRLKRIISHPFFNFYNGMDYDIALLELEKPAEYSSMVRPISLPDASHVFPAGKAIWVTGWGHTQYGGTNALILQKGEIRVINQTTCENLLPQLITPRMMCVGFLSGGVDSCGGDSGGPLSSVEADGRIFQAGVVSWGDGCAQRNKPGVYTRLPLFRDWIKENTGV

SEQ ID NO: 471 - protein, 242 aa, Artificial Sequence
  MEMBRANE TYPE SERINE PROTEASE 1 (MT-SP1) protease domain Q38H/I41S/D60bT/F60eS/Y60gW/D96F/F97S/ins97aD/T98G /F99L/C122S/G151H/Q175L/Q192D
VVGGTDADEGEWPWQVSLHALGHGHSCGASLISPNWLVSAAHCYIDTRGSRWSDPTQWTAFLGLHDQSQRSAPGVQERRLKRIISHPFFNFSDGLDYDIALLELEKPAEYSSMVRPISLPDASHVFPAGKAIWVTGWGHTQYGGTHALILQKGEIRVINQTTCENLLPQLITPRMMCVGFLSGGVDSCDGDSGGPLSSVEADGRIFQAGVVSWGDGCAQRNKPGVYTRLPLFRDWIKENTGV

SEQ ID NO: 472 - protein, 242 aa, Artificial Sequence
  MEMBRANE TYPE SERINE PROTEASE 1 (MT-SP1) protease domain Q38H/I41S/D60bT/F60eS/Y60gW/D96F/F97Y/ins97aD/T98G /F99L/C122S/G151H/Q175L/Q192D
VVGGTDADEGEWPWQVSLHALGHGHSCGASLISPNWLVSAAHCYIDTRGSRWSDPTQWTAFLGLHDQSQRSAPGVQERRLKRIISHPFFNFYDGLDYDIALLELEKPAEYSSMVRPISLPDASHVFPAGKAIWVTGWGHTQYGGTHALILQKGEIRVINQTTCENLLPQLITPRMMCVGFLSGGVDSCDGDSGGPLSSVEADGRIFQAGVVSWGDGCAQRNKPGVYTRLPLFRDWIKENTGV

SEQ ID NO: 473 - protein, 242 aa, Artificial Sequence
  MEMBRANE TYPE SERINE PROTEASE 1 (MT-SP1) protease domain Q38H/I41S/D60bT/F60eS/Y60gW/D96Y/F97N/ins97aE/T98S /F99L/C122S/G151H/Q175L/Q192D
VVGGTDADEGEWPWQVSLHALGHGHSCGASLISPNWLVSAAHCYIDTRGSRWSDPTQWTAFLGLHDQSQRSAPGVQERRLKRIISHPFFNYNESLDYDIALLELEKPAEYSSMVRPISLPDASHVFPAGKAIWVTGWGHTQYGGTHALILQKGEIRVINQTTCENLLPQLITPRMMCVGFLSGGVDSCDGDSGGPLSSVEADGRIFQAGVVSWGDGCAQRNKPGVYTRLPLFRDWIKENTGV

SEQ ID NO: 474 - protein, 242 aa, Artificial Sequence
  MEMBRANE TYPE SERINE PROTEASE 1 (MT-SP1) protease domain Q38H/I41S/D60bT/F60eS/Y60gW/D96Y/F97R/ins97aD/T98G /F99L/C122S/G151H/Q175L/Q192D
VVGGTDADEGEWPWQVSLHALGHGHSCGASLISPNWLVSAAHCYIDTRGSRWSDPTQWTAFLGLHDQSQRSAPGVQERRLKRIISHPFFNYRDGLDYDIALLELEKPAEYSSMVRPISLPDASHVFPAGKAIWVTGWGHTQYGGTHALILQKGEIRVINQTTCENLLPQLITPRMMCVGFLSGGVDSCDGDSGGPLSSVEADGRIFQAGVVSWGDGCAQRNKPGVYTRLPLFRDWIKENTGV

SEQ ID NO: 475 - protein, 242 aa, Artificial Sequence
  MEMBRANE TYPE SERINE PROTEASE 1 (MT-SP1) protease domain Q38H/I41A/D60bT/F60eK/Y60gF/F97T/ins97aE/T98G/F99L /C122S/H143R/G151N/Q175L/Q192V
VVGGTDADEGEWPWQVSLHALGHGHACGASLISPNWLVSAAHCYIDTRGKRFSDPTQWTAFLGLHDQSQRSAPGVQERRLKRIISHPFFNDTEGLDYDIALLELEKPAEYSSMVRPISLPDASHVFPAGKAIWVTGWGRTQYGGTNALILQKGEIRVINQTTCENLLPQLITPRMMCVGFLSGGVDSCVGDSGGPLSSVEADGRIFQAGVVSWGDGCAQRNKPGVYTRLPLFRDWIKENTGV

SEQ ID NO: 476 - protein, 241 aa, Artificial Sequence
  MEMBRANE TYPE SERINE PROTEASE 1 (MT-SP1) protease domain Q38Y/I41S/D60bV/F60eR/Y60gF/D96M/F97N/T98G/F99L/C1 22S/G151N/Q175L/Q192D
VVGGTDADEGEWPWQVSLHALGYGHSCGASLISPNWLVSAAHCYIDVRGRRFSDPTQWTAFLGLHDQSQRSAPGVQERRLKRIISHPFFNMNGLDYDIALLELEKPAEYSSMVRPISLPDASHVFPAGKAIWVTGWGHTQYGGTNALILQKGEIRVINQTTCENLLPQLITPRMMCVGFLSGGVDSCDGDSGGPLSSVEADGRIFQAGVVSWGDGCAQRNKPGVYTRLPLFRDWIKENTGV

SEQ ID NO: 477 - protein, 241 aa, Artificial Sequence
  MEMBRANE TYPE SERINE PROTEASE 1 (MT-SP1) protease domain Q38E/I41S/D60bV/F60eK/Y60gW/D96M/F97N/T98G/F99L/C1 22S/G151N/Q175L/Q192D
VVGGTDADEGEWPWQVSLHALGEGHSCGASLISPNWLVSAAHCYIDVRGKRWSDPTQWTAFLGLHDQSQRSAPGVQERRLKRIISHPFFNMNGLDYDIALLELEKPAEYSSMVRPISLPDASHVFPAGKAIWVTGWGHTQYGGTNALILQKGEIRVINQTTCENLLPQLITPRMMCVGFLSGGVDSCDGDSGGPLSSVEADGRIFQAGVVSWGDGCAQRNKPGVYTRLPLFRDWIKENTGV

SEQ ID NO: 478 - protein, 241 aa, Artificial Sequence
  MEMBRANE TYPE SERINE PROTEASE 1 (MT-SP1) protease domain Q38Y/I41S/D60bT/F60eR/Y60gW/D96M/F97N/T98G/F99L/C1 22S/G151N/Q175L/Q192D
VVGGTDADEGEWPWQVSLHALGYGHSCGASLISPNWLVSAAHCYIDTRGRRWSDPTQWTAFLGLHDQSQRSAPGVQERRLKRIISHPFFNMNGLDYDIALLELEKPAEYSSMVRPISLPDASHVFPAGKAIWVTGWGHTQYGGTNALILQKGEIRVINQTTCENLLPQLITPRMMCVGFLSGGVDSCDGDSGGPLSSVEADGRIFQAGVVSWGDGCAQRNKPGVYTRLPLFRDWIKENTGV

SEQ ID NO: 479 - protein, 241 aa, Artificial Sequence
  MEMBRANE TYPE SERINE PROTEASE 1 (MT-SP1) protease domain Q38H/I41S/F60eT/Y60gW/D96M/F97N/T98G/F99L/C122S/G1 51N/Q175L/Q192D
VVGGTDADEGEWPWQVSLHALGHGHSCGASLISPNWLVSAAHCYIDDRGTRWSDPTQWTAFLGLHDQSQRSAPGVQERRLKRIISHPFFNMNGLDYDIALLELEKPAEYSSMVRPISLPDASHVFPAGKAIWVTGWGHTQYGGTNALILQKGEIRVINQTTCENLLPQLITPRMMCVGFLSGGVDSCDGDSGGPLSSVEADGRIFQAGVVSWGDGCAQRNKPGVYTRLPLFRDWIKENTGV

SEQ ID NO: 480 - protein, 241 aa, Artificial Sequence
  MEMBRANE TYPE SERINE PROTEASE 1 (MT-SP1) protease domain Q38H/I41S/D60bT/F60eK/D96V/F97N/T98G/F99L/C122S/G1 51N/Q175L/Q192D
VVGGTDADEGEWPWQVSLHALGHGHSCGASLISPNWLVSAAHCYIDTRGKRYSDPTQWTAFLGLHDQSQRSAPGVQERRLKRIISHPFFNVNGLDYDIALLELEKPAEYSSMVRPISLPDASHVFPAGKAIWVTGWGHTQYGGTNALILQKGEIRVINQTTCENLLPQLITPRMMCVGFLSGGVDSCDGDSGGPLSSVEADGRIFQAGVVSWGDGCAQRNKPGVYTRLPLFRDWIKENTGV

SEQ ID NO: 481 - protein, 241 aa, Artificial Sequence
  MEMBRANE TYPE SERINE PROTEASE 1 (MT-SP1) protease domain I41S/D60bT/F60eR/Y60gW/D96M/F97N/T98G/F99L/C122S/G 151N/Q175L/Q192D
VVGGTDADEGEWPWQVSLHALGQGHSCGASLISPNWLVSAAHCYIDTRGRRWSDPTQWTAFLGLHDQSQRSAPGVQERRLKRIISHPFFNMNGLDYDIALLELEKPAEYSSMVRPISLPDASHVFPAGKAIWVTGWGHTQYGGTNALILQKGEIRVINQTTCENLLPQLITPRMMCVGFLSGGVDSCDGDSGGPLSSVEADGRIFQAGVVSWGDGCAQRNKPGVYTRLPLFRDWIKENTGV

SEQ ID NO: 482 - protein, 241 aa, Artificial Sequence
  MEMBRANE TYPE SERINE PROTEASE 1 (MT-SP1) protease domain Q38Y/D60bT/F60eR/Y60gW/D96M/F97N/T98G/F99L/C122S/G 151N/Q175L/Q192D
VVGGTDADEGEWPWQVSLHALGYGHICGASLISPNWLVSAAHCYIDTRGRRWSDPTQWTAFLGLHDQSQRSAPGVQERRLKRIISHPFFNMNGLDYDIALLELEKPAEYSSMVRPISLPDASHVFPAGKAIWVTGWGHTQYGGTNALILQKGEIRVINQTTCENLLPQLITPRMMCVGFLSGGVDSCDGDSGGPLSSVEADGRIFQAGVVSWGDGCAQRNKPGVYTRLPLFRDWIKENTGV

SEQ ID NO: 483 - protein, 241 aa, Artificial Sequence
  MEMBRANE TYPE SERINE PROTEASE 1 (MT-SP1) protease domain Q38Y/I41S/F60eR/Y60gW/D96M/F97N/T98G/F99L/C122S/G1 51N/Q175L/Q192D
VVGGTDADEGEWPWQVSLHALGYGHSCGASLISPNWLVSAAHCYIDDRGRRWSDPTQWTAFLGLHDQSQRSAPGVQERRLKRIISHPFFNMNGLDYDIALLELEKPAEYSSMVRPISLPDASHVFPAGKAIWVTGWGHTQYGGTNALILQKGEIRVINQTTCENLLPQLITPRMMCVGFLSGGVDSCDGDSGGPLSSVEADGRIFQAGVVSWGDGCAQRNKPGVYTRLPLFRDWIKENTGV

SEQ ID NO: 484 - protein, 241 aa, Artificial Sequence
  MEMBRANE TYPE SERINE PROTEASE 1 (MT-SP1) protease domain Q38Y/I41S/D60bT/Y60gW/D96M/F97N/T98G/F99L/C122S/G1 51N/Q175L/Q192D
VVGGTDADEGEWPWQVSLHALGYGHSCGASLISPNWLVSAAHCYIDTRGFRWSDPTQWTAFLGLHDQSQRSAPGVQERRLKRIISHPFFNMNGLDYDIALLELEKPAEYSSMVRPISLPDASHVFPAGKAIWVTGWGHTQYGGTNALILQKGEIRVINQTTCENLLPQLITPRMMCVGFLSGGVDSCDGDSGGPLSSVEADGRIFQAGVVSWGDGCAQRNKPGVYTRLPLFRDWIKENTGV

SEQ ID NO: 485 - protein, 241 aa, Artificial Sequence
  MEMBRANE TYPE SERINE PROTEASE 1 (MT-SP1) protease domain Q38Y/I41S/D60bT/F60eR/D96M/F97N/T98G/F99L/C122S/G1 51N/Q175L/Q192D
VVGGTDADEGEWPWQVSLHALGYGHSCGASLISPNWLVSAAHCYIDTRGRRYSDPTQWTAFLGLHDQSQRSAPGVQERRLKRIISHPFFNMNGLDYDIALLELEKPAEYSSMVRPISLPDASHVFPAGKAIWVTGWGHTQYGGTNALILQKGEIRVINQTTCENLLPQLITPRMMCVGFLSGGVDSCDGDSGGPLSSVEADGRIFQAGVVSWGDGCAQRNKPGVYTRLPLFRDWIKENTGV

SEQ ID NO: 486 - protein, 241 aa, Artificial Sequence
  MEMBRANE TYPE SERINE PROTEASE 1 (MT-SP1) protease domain Q38Y/I41S/D60bT/F60eR/Y60gW/F97N/T98G/F99L/C122S/G 151N/Q175L/Q192D
VVGGTDADEGEWPWQVSLHALGYGHSCGASLISPNWLVSAAHCYIDTRGRRWSDPTQWTAFLGLHDQSQRSAPGVQERRLKRIISHPFFNDNGLDYDIALLELEKPAEYSSMVRPISLPDASHVFPAGKAIWVTGWGHTQYGGTNALILQKGEIRVINQTTCENLLPQLITPRMMCVGFLSGGVDSCDGDSGGPLSSVEADGRIFQAGVVSWGDGCAQRNKPGVYTRLPLFRDWIKENTGV

SEQ ID NO: 487 - protein, 241 aa, Artificial Sequence
  MEMBRANE TYPE SERINE PROTEASE 1 (MT-SP1) protease domain Q38Y/I41S/D60bT/F60eR/Y60gW/D96M/T98G/F99L/C122S/G 151N/Q175L/Q192D
VVGGTDADEGEWPWQVSLHALGYGHSCGASLISPNWLVSAAHCYIDTRGRRWSDPTQWTAFLGLHDQSQRSAPGVQERRLKRIISHPFFNMFGLDYDIALLELEKPAEYSSMVRPISLPDASHVFPAGKAIWVTGWGHTQYGGTNALILQKGEIRVINQTTCENLLPQLITPRMMCVGFLSGGVDSCDGDSGGPLSSVEADGRIFQAGVVSWGDGCAQRNKPGVYTRLPLFRDWIKENTGV

SEQ ID NO: 488 - protein, 241 aa, Artificial Sequence
  MEMBRANE TYPE SERINE PROTEASE 1 (MT-SP1) protease domain Q38Y/I41S/D60bT/F60eR/Y60gW/D96M/F97N/F99L/C122S/G 151N/Q175L/Q192D
VVGGTDADEGEWPWQVSLHALGYGHSCGASLISPNWLVSAAHCYIDTRGRRWSDPTQWTAFLGLHDQSQRSAPGVQERRLKRIISHPFFNMNTLDYDIALLELEKPAEYSSMVRPISLPDASHVFPAGKAIWVTGWGHTQYGGTNALILQKGEIRVINQTTCENLLPQLITPRMMCVGFLSGGVDSCDGDSGGPLSSVEADGRIFQAGVVSWGDGCAQRNKPGVYTRLPLFRDWIKENTGV

SEQ ID NO: 489 - protein, 241 aa, Artificial Sequence
  MEMBRANE TYPE SERINE PROTEASE 1 (MT-SP1) protease domain Q38Y/I41S/D60bT/F60eR/Y60gW/D96M/F97N/T98G/C122S/G 151N/Q175L/Q192D
VVGGTDADEGEWPWQVSLHALGYGHSCGASLISPNWLVSAAHCYIDTRGRRWSDPTQWTAFLGLHDQSQRSAPGVQERRLKRIISHPFFNMNGFDYDIALLELEKPAEYSSMVRPISLPDASHVFPAGKAIWVTGWGHTQYGGTNALILQKGEIRVINQTTCENLLPQLITPRMMCVGFLSGGVDSCDGDSGGPLSSVEADGRIFQAGVVSWGDGCAQRNKPGVYTRLPLFRDWIKENTGV

SEQ ID NO: 490 - protein, 241 aa, Artificial Sequence
  MEMBRANE TYPE SERINE PROTEASE 1 (MT-SP1) protease domain Q38Y/I41S/D60bT/F60eR/Y60gW/D96M/F97N/T98G/F99L/C1 22S/G151N/Q192D
VVGGTDADEGEWPWQVSLHALGYGHSCGASLISPNWLVSAAHCYIDTRGRRWSDPTQWTAFLGLHDQSQRSAPGVQERRLKRIISHPFFNMNGLDYDIALLELEKPAEYSSMVRPISLPDASHVFPAGKAIWVTGWGHTQYGGTNALILQKGEIRVINQTTCENLLPQQITPRMMCVGFLSGGVDSCDGDSGGPLSSVEADGRIFQAGVVSWGDGCAQRNKPGVYTRLPLFRDWIKENTGV

SEQ ID NO: 491 - protein, 241 aa, Artificial Sequence
  MEMBRANE TYPE SERINE PROTEASE 1 (MT-SP1) protease domain Q38Y/I41S/D60bT/F60eR/Y60gW/D96M/F97N/T98G/F99L/C1 22S/G151N/Q175L
VVGGTDADEGEWPWQVSLHALGYGHSCGASLISPNWLVSAAHCYIDTRGRRWSDPTQWTAFLGLHDQSQRSAPGVQERRLKRIISHPFFNMNGLDYDIALLELEKPAEYSSMVRPISLPDASHVFPAGKAIWVTGWGHTQYGGTNALILQKGEIRVINQTTCENLLPQLITPRMMCVGFLSGGVDSCQGDSGGPLSSVEADGRIFQAGVVSWGDGCAQRNKPGVYTRLPLFRDWIKENTGV

SEQ ID NO: 492 - protein, 241 aa, Artificial Sequence [sequence omitted]

SEQ ID NO: 493 - protein, 242 aa, Artificial Sequence
  MEMBRANE TYPE SERINE PROTEASE 1 (MT-SP1) protease domain Q38H/I41S/D60bT/F60eS/Y60gW/D96K/F97G/ins97aV/T98P /F99L/M117K/C122S/G151H/Q175L/Q192D
VVGGTDADEGEWPWQVSLHALGHGHSCGASLISPNWLVSAAHCYIDTRGSRWSDPTQWTAFLGLHDQSQRSAPGVQERRLKRIISHPFFNKGVPLDYDIALLELEKPAEYSSKVRPISLPDASHVFPAGKAIWVTGWGHTQYGGTHALILQKGEIRVINQTTCENLLPQLITPRMMCVGFLSGGVDSCDGDSGGPLSSVEADGRIFQAGVVSWGDGCAQRNKPGVYTRLPLFRDWIKENTGV

SEQ ID NO: 494 - protein, 242 aa, Artificial Sequence
  MEMBRANE TYPE SERINE PROTEASE 1 (MT-SP1) protease domain L36Q/Q38H/I41S/D60bT/F60eS/Y60gW/D96K/F97G/ins97aV /T98P/F99L/C122S/G151H/Q175L/Q192D
VVGGTDADEGEWPWQVSLHAQGHGHSCGASLISPNWLVSAAHCYIDTRGSRWSDPTQWTAFLGLHDQSQRSAPGVQERRLKRIISHPFFNKGVPLDYDIALLELEKPAEYSSMVRPISLPDASHVFPAGKAIWVTGWGHTQYGGTHALILQKGEIRVINQTTCENLLPQLITPRMMCVGFLSGGVDSCDGDSGGPLSSVEADGRIFQAGVVSWGDGCAQRNKPGVYTRLPLFRDWIKENTGV

SEQ ID NO: 495 - protein, 242 aa, Artificial Sequence
  MEMBRANE TYPE SERINE PROTEASE 1 (MT-SP1) protease domain Q38H/I41S/D60bT/F60eS/Y60gW/D96K/F97G/ins97aV/T98P /F99L/C122S/T150S/G151H/Q175L/Q192D/Q209L
VVGGTDADEGEWPWQVSLHALGHGHSCGASLISPNWLVSAAHCYIDTRGSRWSDPTQWTAFLGLHDQSQRSAPGVQERRLKRIISHPFFNKGVPLDYDIALLELEKPAEYSSMVRPISLPDASHVFPAGKAIWVTGWGHTQYGGSHALILQKGEIRVINQTTCENLLPQLITPRMMCVGFLSGGVDSCDGDSGGPLSSVEADGRIFLAGVVSWGDGCAQRNKPGVYTRLPLFRDWIKENTGV

SEQ ID NO: 496 - protein, 242 aa, Artificial Sequence
  MEMBRANE TYPE SERINE PROTEASE 1 (MT-SP1) protease domain Q38H/I41S/D60bT/F60eS/Y60gW/D96K/F97G/ins97aA/T98P /F99L/C122S/G151H/Q175L/Q192D
VVGGTDADEGEWPWQVSLHALGHGHSCGASLISPNWLVSAAHCYIDTRGSRWSDPTQWTAFLGLHDQSQRSAPGVQERRLKRIISHPFFNKGAPLDYDIALLELEKPAEYSSMVRPISLPDASHVFPAGKAIWVTGWGHTQYGGTHALILQKGEIRVINQTTCENLLPQLITPRMMCVGFLSGGVDSCDGDSGGPLSSVEADGRIFQAGVVSWGDGCAQRNKPGVYTRLPLFRDWIKENTGV

SEQ ID NO: 497 - protein, 241 aa, Artificial Sequence
  MEMBRANE TYPE SERINE PROTEASE 1 (MT-SP1) protease domain I41G/F97A/F99L/C122S/G151H/Q175L/Q192G/D217L
VVGGTDADEGEWPWQVSLHALGQGHGCGASLISPNWLVSAAHCYIDDRGFRYSDPTQWTAFLGLHDQSQRSAPGVQERRLKRIISHPFFNDATLDYDIALLELEKPAEYSSMVRPISLPDASHVFPAGKAIWVTGWGHTQYGGTHALILQKGEIRVINQTTCENLLPQLITPRMMCVGFLSGGVDSCGGDSGGPLSSVEADGRIFQAGVVSWGLGCAQRNKPGVYTRLPLFRDWIKENTGV

SEQ ID NO: 498 - protein, 241 aa, Artificial Sequence
  MEMBRANE TYPE SERINE PROTEASE 1 (MT-SP1) protease domain I41G/F97S/F99L/C122S/G151N/Q175I/Q192T/D217T
VVGGTDADEGEWPWQVSLHALGQGHGCGASLISPNWLVSAAHCYIDDRGFRYSDPTQWTAFLGLHDQSQRSAPGVQERRLKRIISHPFFNDSTLDYDIALLELEKPAEYSSMVRPISLPDASHVFPAGKAIWVTGWGHTQYGGTNALILQKGEIRVINQTTCENLLPQIITPRMMCVGFLSGGVDSCTGDSGGPLSSVEADGRIFQAGVVSWGTGCAQRNKPGVYTRLPLFRDWIKENTGV

SEQ ID NO: 499 - protein, 241 aa, Artificial Sequence
  MEMBRANE TYPE SERINE PROTEASE 1 (MT-SP1) protease domain I41R/F97A/F99L/C122S/G151N/Q175R/Q192G/D217Q
VVGGTDADEGEWPWQVSLHALGQGHRCGASLISPNWLVSAAHCYIDDRGFRYSDPTQWTAFLGLHDQSQRSAPGVQERRLKRIISHPFFNDATLDYDIALLELEKPAEYSSMVRPISLPDASHVFPAGKAIWVTGWGHTQYGGTNALILQKGEIRVINQTTCENLLPQRITPRMMCVGFLSGGVDSCGGDSGGPLSSVEADGRIFQAGVVSWGQGCAQRNKPGVYTRLPLFRDWIKENTGV

SEQ ID NO: 500 - protein, 241 aa, Artificial Sequence
  MEMBRANE TYPE SERINE PROTEASE 1 (MT-SP1) protease domain I41S/F97E/F99L/C122S/G151N/Q175G/Q192R/D217A
VVGGTDADEGEWPWQVSLHALGQGHSCGASLISPNWLVSAAHCYIDDRGFRYSDPTQWTAFLGLHDQSQRSAPGVQERRLKRIISHPFFNDETLDYDIALLELEKPAEYSSMVRPISLPDASHVFPAGKAIWVTGWGHTQYGGTNALILQKGEIRVINQTTCENLLPQGITPRMMCVGFLSGGVDSCRGDSGGPLSSVEADGRIFQAGVVSWGAGCAQRNKPGVYTRLPLFRDWIKENTGV

SEQ ID NO: 501 - protein, 241 aa, Artificial Sequence
  MEMBRANE TYPE SERINE PROTEASE 1 (MT-SP1) protease domain I41G/F97S/F99L/C122S/G151T/Q175R/Q192A/D217Y
VVGGTDADEGEWPWQVSLHALGQGHGCGASLISPNWLVSAAHCYIDDRGFRYSDPTQWTAFLGLHDQSQRSAPGVQERRLKRIISHPFFNDSTLDYDIALLELEKPAEYSSMVRPISLPDASHVFPAGKAIWVTGWGHTQYGGTTALILQKGEIRVINQTTCENLLPQRITPRMMCVGFLSGGVDSCAGDSGGPLSSVEADGRIFQAGVVSWGYGCAQRNKPGVYTRLPLFRDWIKENTGV

SEQ ID NO: 502 - protein, 241 aa, Artificial Sequence
  MEMBRANE TYPE SERINE PROTEASE 1 (MT-SP1) protease domain I41G/F97L/F99L/C122S/G151N/Q175A/Q192V/D217R
VVGGTDADEGEWPWQVSLHALGQGHGCGASLISPNWLVSAAHCYIDDRGFRYSDPTQWTAFLGLHDQSQRSAPGVQERRLKRIISHPFFNDLTLDYDIALLELEKPAEYSSMVRPISLPDASHVFPAGKAIWVTGWGHTQYGGTNALILQKGEIRVINQTTCENLLPQAITPRMMCVGFLSGGVDSCVGDSGGPLSSVEADGRIFQAGVVSWGRGCAQRNKPGVYTRLPLFRDWIKENTGV

SEQ ID NO: 503 - protein, 241 aa, Artificial Sequence
  MEMBRANE TYPE SERINE PROTEASE 1 (MT-SP1) protease domain I41G/F97T/F99M/C122S/G151D/Q175T/Q192T/D217V
VVGGTDADEGEWPWQVSLHALGQGHGCGASLISPNWLVSAAHCYIDDRGFRYSDPTQWTAFLGLHDQSQRSAPGVQERRLKRIISHPFFNDTTMDYDIALLELEKPAEYSSMVRPISLPDASHVFPAGKAIWVTGWGHTQYGGTDALILQKGEIRVINQTTCENLLPQTITPRMMCVGFLSGGVDSCTGDSGGPLSSVEADGRIFQAGVVSWGVGCAQRNKPGVYTRLPLFRDWIKENTGV

SEQ ID NO: 504 - protein, 241 aa, Artificial Sequence
  MEMBRANE TYPE SERINE PROTEASE 1 (MT-SP1) protease domain I41G/F97L/F99L/C122S/G151T/Q175M/Q192D/D217M
VVGGTDADEGEWPWQVSLHALGQGHGCGASLISPNWLVSAAHCYIDDRGFRYSDPTQWTAFLGLHDQSQRSAPGVQERRLKRIISHPFFNDLTLDYDIALLELEKPAEYSSMVRPISLPDASHVFPAGKAIWVTGWGHTQYGGTTALILQKGEIRVINQTTCENLLPQMITPRMMCVGFLSGGVDSCDGDSGGPLSSVEADGRIFQAGVVSWGMGCAQRNKPGVYTRLPLFRDWIKENTGV

SEQ ID NO: 505 - protein, 241 aa, Artificial Sequence
  MEMBRANE TYPE SERINE PROTEASE 1 (MT-SP1) protease domain F97S/F99L/C122S/G151N/Q175I/Q192T/D217T
VVGGTDADEGEWPWQVSLHALGQGHICGASLISPNWLVSAAHCYIDDRGFRYSDPTQWTAFLGLHDQSQRSAPGVQERRLKRIISHPFFNDSTLDYDIALLELEKPAEYSSMVRPISLPDASHVFPAGKAIWVTGWGHTQYGGTNALILQKGEIRVINQTTCENLLPQIITPRMMCVGFLSGGVDSCTGDSGGPLSSVEADGRIFQAGVVSWGTGCAQRNKPGVYTRLPLFRDWIKENTGV

SEQ ID NO: 506 - protein, 241 aa, Artificial Sequence
  MEMBRANE TYPE SERINE PROTEASE 1 (MT-SP1) protease domain I41G/F99L/C122S/G151N/Q175I/Q192T/D217T
VVGGTDADEGEWPWQVSLHALGQGHGCGASLISPNWLVSAAHCYIDDRGFRYSDPTQWTAFLGLHDQSQRSAPGVQERRLKRIISHPFFNDFTLDYDIALLELEKPAEYSSMVRPISLPDASHVFPAGKAIWVTGWGHTQYGGTNALILQKGEIRVINQTTCENLLPQIITPRMMCVGFLSGGVDSCTGDSGGPLSSVEADGRIFQAGVVSWGTGCAQRNKPGVYTRLPLFRDWIKENTGV

SEQ ID NO: 507 - protein, 241 aa, Artificial Sequence
  MEMBRANE TYPE SERINE PROTEASE 1 (MT-SP1) protease domain I41G/F97S/C122S/G151N/Q175I/Q192T/D217T
VVGGTDADEGEWPWQVSLHALGQGHGCGASLISPNWLVSAAHCYIDDRGFRYSDPTQWTAFLGLHDQSQRSAPGVQERRLKRIISHPFFNDSTFDYDIALLELEKPAEYSSMVRPISLPDASHVFPAGKAIWVTGWGHTQYGGTNALILQKGEIRVINQTTCENLLPQIITPRMMCVGFLSGGVDSCTGDSGGPLSSVEADGRIFQAGVVSWGTGCAQRNKPGVYTRLPLFRDWIKENTGV

SEQ ID NO: 508 - protein, 241 aa, Artificial Sequence
  MEMBRANE TYPE SERINE PROTEASE 1 (MT-SP1) protease domain I41G/F97S/F99L/C122S/Q175I/Q192T/D217T
VVGGTDADEGEWPWQVSLHALGQGHGCGASLISPNWLVSAAHCYIDDRGFRYSDPTQWTAFLGLHDQSQRSAPGVQERRLKRIISHPFFNDSTLDYDIALLELEKPAEYSSMVRPISLPDASHVFPAGKAIWVTGWGHTQYGGTGALILQKGEIRVINQTTCENLLPQIITPRMMCVGFLSGGVDSCTGDSGGPLSSVEADGRIFQAGVVSWGTGCAQRNKPGVYTRLPLFRDWIKENTGV

SEQ ID NO: 509 - protein, 241 aa, Artificial Sequence
  MEMBRANE TYPE SERINE PROTEASE 1 (MT-SP1) protease domain I41G/F97S/F99L/C122S/G151N/Q192T/D217T
VVGGTDADEGEWPWQVSLHALGQGHGCGASLISPNWLVSAAHCYIDDRGFRYSDPTQWTAFLGLHDQSQRSAPGVQERRLKRIISHPFFNDSTLDYDIALLELEKPAEYSSMVRPISLPDASHVFPAGKAIWVTGWGHTQYGGTNALILQKGEIRVINQTTCENLLPQQITPRMMCVGFLSGGVDSCTGDSGGPLSSVEADGRIFQAGVVSWGTGCAQRNKPGVYTRLPLFRDWIKENTGV

SEQ ID NO: 510 - protein, 241 aa, Artificial Sequence
  MEMBRANE TYPE SERINE PROTEASE 1 (MT-SP1) protease domain I41G/F97S/F99L/C122S/G151N/Q175I/D217T
VVGGTDADEGEWPWQVSLHALGQGHGCGASLISPNWLVSAAHCYIDDRGFRYSDPTQWTAFLGLHDQSQRSAPGVQERRLKRIISHPFFNDSTLDYDIALLELEKPAEYSSMVRPISLPDASHVFPAGKAIWVTGWGHTQYGGTNALILQKGEIRVINQTTCENLLPQIITPRMMCVGFLSGGVDSCQGDSGGPLSSVEADGRIFQAGVVSWGTGCAQRNKPGVYTRLPLFRDWIKENTGV

SEQ ID NO: 511 - protein, 241 aa, Artificial Sequence
  MEMBRANE TYPE SERINE PROTEASE 1 (MT-SP1) protease domain I41G/F97S/F99L/C122S/G151N/Q175I/Q192T
VVGGTDADEGEWPWQVSLHALGQGHGCGASLISPNWLVSAAHCYIDDRGFRYSDPTQWTAFLGLHDQSQRSAPGVQERRLKRIISHPFFNDSTLDYDIALLELEKPAEYSSMVRPISLPDASHVFPAGKAIWVTGWGHTQYGGTNALILQKGEIRVINQTTCENLLPQIITPRMMCVGFLSGGVDSCTGDSGGPLSSVEADGRIFQAGVVSWGDGCAQRNKPGVYTRLPLFRDWIKENTGV

SEQ ID NO: 512 - protein, 242 aa, Artificial Sequence
  MEMBRANE TYPE SERINE PROTEASE 1 (MT-SP1) protease domain F97R/ins97aT/T98V/C122S/Q175M/Q192T/D217S
VVGGTDADEGEWPWQVSLHALGQGHICGASLISPNWLVSAAHCYIDDRGFRYSDPTQWTAFLGLHDQSQRSAPGVQERRLKRIISHPFFNDRTVFDYDIALLELEKPAEYSSMVRPISLPDASHVFPAGKAIWVTGWGHTQYGGTGALILQKGEIRVINQTTCENLLPQMITPRMMCVGFLSGGVDSCTGDSGGPLSSVEADGRIFQAGVVSWGSGCAQRNKPGVYTRLPLFRDWIKENTGV

SEQ ID NO: 513 - protein, 242 aa, Artificial Sequence
  MEMBRANE TYPE SERINE PROTEASE 1 (MT-SP1) protease domain F97V/ins97aH/T98R/F99L/C122S/Q175R/Q192G/D217S
VVGGTDADEGEWPWQVSLHALGQGHICGASLISPNWLVSAAHCYIDDRGFRYSDPTQWTAFLGLHDQSQRSAPGVQERRLKRIISHPFFNDVHRLDYDIALLELEKPAEYSSMVRPISLPDASHVFPAGKAIWVTGWGHTQYGGTGALILQKGEIRVINQTTCENLLPQRITPRMMCVGFLSGGVDSCGGDSGGPLSSVEADGRIFQAGVVSWGSGCAQRNKPGVYTRLPLFRDWIKENTGV

SEQ ID NO: 514 - protein, 241 aa, Artificial Sequence
  MEMBRANE TYPE SERINE PROTEASE 1 (MT-SP1) protease domain F97Q/F99L/C122S/Q175N/Q192V/D217G
VVGGTDADEGEWPWQVSLHALGQGHICGASLISPNWLVSAAHCYIDDRGFRYSDPTQWTAFLGLHDQSQRSAPGVQERRLKRIISHPFFNDQTLDYDIALLELEKPAEYSSMVRPISLPDASHVFPAGKAIWVTGWGHTQYGGTGALILQKGEIRVINQTTCENLLPQNITPRMMCVGFLSGGVDSCVGDSGGPLSSVEADGRIFQAGVVSWGGGCAQRNKPGVYTRLPLFRDWIKENTGV

SEQ ID NO: 515 - protein, 242 aa, Artificial Sequence
  MEMBRANE TYPE SERINE PROTEASE 1 (MT-SP1) protease domain F97L/ins97aM/T98N/F99L/C122S/Q175T/Q192T/D217S
VVGGTDADEGEWPWQVSLHALGQGHICGASLISPNWLVSAAHCYIDDRGFRYSDPTQWTAFLGLHDQSQRSAPGVQERRLKRIISHPFFNDLMNLDYDIALLELEKPAEYSSMVRPISLPDASHVFPAGKAIWVTGWGHTQYGGTGALILQKGEIRVINQTTCENLLPQTITPRMMCVGFLSGGVDSCTGDSGGPLSSVEADGRIFQAGVVSWGSGCAQRNKPGVYTRLPLFRDWIKENTGV

SEQ ID NO: 516 - protein, 242 aa, Artificial Sequence
  MEMBRANE TYPE SERINE PROTEASE 1 (MT-SP1) protease domain F97S/ins97aN/T98G/F99M/C122S/Q175T/Q192T/D217S
VVGGTDADEGEWPWQVSLHALGQGHICGASLISPNWLVSAAHCYIDDRGFRYSDPTQWTAFLGLHDQSQRSAPGVQERRLKRIISHPFFNDSNGMDYDIALLELEKPAEYSSMVRPISLPDASHVFPAGKAIWVTGWGHTQYGGTGALILQKGEIRVINQTTCENLLPQTITPRMMCVGFLSGGVDSCTGDSGGPLSSVEADGRIFQAGVVSWGSGCAQRNKPGVYTRLPLFRDWIKENTGV

SEQ ID NO: 517 - protein, 241 aa, Artificial Sequence
  MEMBRANE TYPE SERINE PROTEASE 1 (MT-SP1) protease domain I41T/F97H/F99L/C122S/G151N/Q175H/Q192V/D217L
VVGGTDADEGEWPWQVSLHALGQGHTCGASLISPNWLVSAAHCYIDDRGFRYSDPTQWTAFLGLHDQSQRSAPGVQERRLKRIISHPFFNDHTLDYDIALLELEKPAEYSSMVRPISLPDASHVFPAGKAIWVTGWGHTQYGGTNALILQKGEIRVINQTTCENLLPQHITPRMMCVGFLSGGVDSCVGDSGGPLSSVEADGRIFQAGVVSWGLGCAQRNKPGVYTRLPLFRDWIKENTGV

SEQ ID NO: 518 - protein, 241 aa, Artificial Sequence
  MEMBRANE TYPE SERINE PROTEASE 1 (MT-SP1) protease domain I41R/F97T/F99L/C122S/G151N/Q175T/Q192T/D217I
VVGGTDADEGEWPWQVSLHALGQGHRCGASLISPNWLVSAAHCYIDDRGFRYSDPTQWTAFLGLHDQSQRSAPGVQERRLKRIISHPFFNDTTLDYDIALLELEKPAEYSSMVRPISLPDASHVFPAGKAIWVTGWGHTQYGGTNALILQKGEIRVINQTTCENLLPQTITPRMMCVGFLSGGVDSCTGDSGGPLSSVEADGRIFQAGVVSWGIGCAQRNKPGVYTRLPLFRDWIKENTGV

SEQ ID NO: 519 - protein, 241 aa, Artificial Sequence
  MEMBRANE TYPE SERINE PROTEASE 1 (MT-SP1) protease domain I41E/F97V/F99L/C122S/G151N/Q175L/Q192S/D217H
VVGGTDADEGEWPWQVSLHALGQGHECGASLISPNWLVSAAHCYIDDRGFRYSDPTQWTAFLGLHDQSQRSAPGVQERRLKRIISHPFFNDVTLDYDIALLELEKPAEYSSMVRPISLPDASHVFPAGKAIWVTGWGHTQYGGTNALILQKGEIRVINQTTCENLLPQLITPRMMCVGFLSGGVDSCSGDSGGPLSSVEADGRIFQAGVVSWGHGCAQRNKPGVYTRLPLFRDWIKENTGV

SEQ ID NO: 520 - protein, 241 aa, Artificial Sequence
  MEMBRANE TYPE SERINE PROTEASE 1 (MT-SP1) protease domain I41D/F97R/F99L/C122S/G151Q/Q175R/Q192V/D217L
VVGGTDADEGEWPWQVSLHALGQGHDCGASLISPNWLVSAAHCYIDDRGFRYSDPTQWTAFLGLHDQSQRSAPGVQERRLKRIISHPFFNDRTLDYDIALLELEKPAEYSSMVRPISLPDASHVFPAGKAIWVTGWGHTQYGGTQALILQKGEIRVINQTTCENLLPQRITPRMMCVGFLSGGVDSCVGDSGGPLSSVEADGRIFQAGVVSWGLGCAQRNKPGVYTRLPLFRDWIKENTGV

SEQ ID NO: 521 - protein, 241 aa, Artificial Sequence
  MEMBRANE TYPE SERINE PROTEASE 1 (MT-SP1) protease domain I41E/F97R/F99L/C122S/G151Q/Q175G/Q192T/D217V
VVGGTDADEGEWPWQVSLHALGQGHECGASLISPNWLVSAAHCYIDDRGFRYSDPTQWTAFLGLHDQSQRSAPGVQERRLKRIISHPFFNDRTLDYDIALLELEKPAEYSSMVRPISLPDASHVFPAGKAIWVTGWGHTQYGGTQALILQKGEIRVINQTTCENLLPQGITPRMMCVGFLSGGVDSCTGDSGGPLSSVEADGRIFQAGVVSWGVGCAQRNKPGVYTRLPLFRDWIKENTGV

SEQ ID NO: 522 - protein, 241 aa, Artificial Sequence
  MEMBRANE TYPE SERINE PROTEASE 1 (MT-SP1) protease domain I41D/F97T/F99L/C122S/G151N/Q175S/Q192T/D217A
VVGGTDADEGEWPWQVSLHALGQGHDCGASLISPNWLVSAAHCYIDDRGFRYSDPTQWTAFLGLHDQSQRSAPGVQERRLKRIISHPFFNDTTLDYDIALLELEKPAEYSSMVRPISLPDASHVFPAGKAIWVTGWGHTQYGGTNALILQKGEIRVINQTTCENLLPQSITPRMMCVGFLSGGVDSCTGDSGGPLSSVEADGRIFQAGVVSWGAGCAQRNKPGVYTRLPLFRDWIKENTGV

SEQ ID NO: 523 - protein, 241 aa, Artificial Sequence
  MEMBRANE TYPE SERINE PROTEASE 1 (MT-SP1) protease domain I41E/F97A/F99M/C122S/G151N/Q175R/Q192S/D217E
VVGGTDADEGEWPWQVSLHALGQGHECGASLISPNWLVSAAHCYIDDRGFRYSDPTQWTAFLGLHDQSQRSAPGVQERRLKRIISHPFFNDATMDYDIALLELEKPAEYSSMVRPISLPDASHVFPAGKAIWVTGWGHTQYGGTNALILQKGEIRVINQTTCENLLPQRITPRMMCVGFLSGGVDSCSGDSGGPLSSVEADGRIFQAGVVSWGEGCAQRNKPGVYTRLPLFRDWIKENTGV

SEQ ID NO: 524 - protein, 241 aa, Artificial Sequence
  MEMBRANE TYPE SERINE PROTEASE 1 (MT-SP1) protease domain I41G/F99L/C122S/Q175I/Q192T/D217T
VVGGTDADEGEWPWQVSLHALGQGHGCGASLISPNWLVSAAHCYIDDRGFRYSDPTQWTAFLGLHDQSQRSAPGVQERRLKRIISHPFFNDFTLDYDIALLELEKPAEYSSMVRPISLPDASHVFPAGKAIWVTGWGHTQYGGTGALILQKGEIRVINQTTCENLLPQIITPRMMCVGFLSGGVDSCTGDSGGPLSSVEADGRIFQAGVVSWGTGCAQRNKPGVYTRLPLFRDWIKENTGV

SEQ ID NO: 525 - protein, 241 aa, Artificial Sequence
  MEMBRANE TYPE SERINE PROTEASE 1 (MT-SP1) protease domain I41G/F99L/C122S/G151N/Q192T/D217T
VVGGTDADEGEWPWQVSLHALGQGHGCGASLISPNWLVSAAHCYIDDRGFRYSDPTQWTAFLGLHDQSQRSAPGVQERRLKRIISHPFFNDFTLDYDIALLELEKPAEYSSMVRPISLPDASHVFPAGKAIWVTGWGHTQYGGTNALILQKGEIRVINQTTCENLLPQQITPRMMCVGFLSGGVDSCTGDSGGPLSSVEADGRIFQAGVVSWGTGCAQRNKPGVYTRLPLFRDWIKENTGV

SEQ ID NO: 526 - protein, 241 aa, Artificial Sequence
  MEMBRANE TYPE SERINE PROTEASE 1 (MT-SP1) protease domain I41G/F99L/C122S/G151N/Q175I/Q192T
VVGGTDADEGEWPWQVSLHALGQGHGCGASLISPNWLVSAAHCYIDDRGFRYSDPTQWTAFLGLHDQSQRSAPGVQERRLKRIISHPFFNDFTLDYDIALLELEKPAEYSSMVRPISLPDASHVFPAGKAIWVTGWGHTQYGGTNALILQKGEIRVINQTTCENLLPQIITPRMMCVGFLSGGVDSCTGDSGGPLSSVEADGRIFQAGVVSWGDGCAQRNKPGVYTRLPLFRDWIKENTGV

SEQ ID NO: 527 - protein, 241 aa, Artificial Sequence
  MEMBRANE TYPE SERINE PROTEASE 1 (MT-SP1) protease domain F97V/F99L/C122S/G151N/Q175L/Q192S/D217H
VVGGTDADEGEWPWQVSLHALGQGHICGASLISPNWLVSAAHCYIDDRGFRYSDPTQWTAFLGLHDQSQRSAPGVQERRLKRIISHPFFNDVTLDYDIALLELEKPAEYSSMVRPISLPDASHVFPAGKAIWVTGWGHTQYGGTNALILQKGEIRVINQTTCENLLPQLITPRMMCVGFLSGGVDSCSGDSGGPLSSVEADGRIFQAGVVSWGHGCAQRNKPGVYTRLPLFRDWIKENTGV

SEQ ID NO: 528 - protein, 241 aa, Artificial Sequence
  MEMBRANE TYPE SERINE PROTEASE 1 (MT-SP1) protease domain I41E/F99L/C122S/G151N/Q175L/Q192S/D217H
VVGGTDADEGEWPWQVSLHALGQGHECGASLISPNWLVSAAHCYIDDRGFRYSDPTQWTAFLGLHDQSQRSAPGVQERRLKRIISHPFFNDFTLDYDIALLELEKPAEYSSMVRPISLPDASHVFPAGKAIWVTGWGHTQYGGTNALILQKGEIRVINQTTCENLLPQLITPRMMCVGFLSGGVDSCSGDSGGPLSSVEADGRIFQAGVVSWGHGCAQRNKPGVYTRLPLFRDWIKENTGV

SEQ ID NO: 529 - protein, 241 aa, Artificial Sequence
  MEMBRANE TYPE SERINE PROTEASE 1 (MT-SP1) protease domain I41E/F97V/F99L/C122S/Q175L/Q192S/D217H
VVGGTDADEGEWPWQVSLHALGQGHECGASLISPNWLVSAAHCYIDDRGFRYSDPTQWTAFLGLHDQSQRSAPGVQERRLKRIISHPFFNDVTLDYDIALLELEKPAEYSSMVRPISLPDASHVFPAGKAIWVTGWGHTQYGGTGALILQKGEIRVINQTTCENLLPQLITPRMMCVGFLSGGVDSCSGDSGGPLSSVEADGRIFQAGVVSWGHGCAQRNKPGVYTRLPLFRDWIKENTGV

SEQ ID NO: 530 - protein, 241 aa, Artificial Sequence
  MEMBRANE TYPE SERINE PROTEASE 1 (MT-SP1) protease domain I41E/F97V/F99L/C122S/G151N/Q192S/D217H
VVGGTDADEGEWPWQVSLHALGQGHECGASLISPNWLVSAAHCYIDDRGFRYSDPTQWTAFLGLHDQSQRSAPGVQERRLKRIISHPFFNDVTLDYDIALLELEKPAEYSSMVRPISLPDASHVFPAGKAIWVTGWGHTQYGGTNALILQKGEIRVINQTTCENLLPQQITPRMMCVGFLSGGVDSCSGDSGGPLSSVEADGRIFQAGVVSWGHGCAQRNKPGVYTRLPLFRDWIKENTGV

SEQ ID NO: 531 - protein, 241 aa, Artificial Sequence
  MEMBRANE TYPE SERINE PROTEASE 1 (MT-SP1) protease domain I41E/F97V/F99L/C122S/G151N/Q175L/D217H
VVGGTDADEGEWPWQVSLHALGQGHECGASLISPNWLVSAAHCYIDDRGFRYSDPTQWTAFLGLHDQSQRSAPGVQERRLKRIISHPFFNDVTLDYDIALLELEKPAEYSSMVRPISLPDASHVFPAGKAIWVTGWGHTQYGGTNALILQKGEIRVINQTTCENLLPQLITPRMMCVGFLSGGVDSCQGDSGGPLSSVEADGRIFQAGVVSWGHGCAQRNKPGVYTRLPLFRDWIKENTGV

SEQ ID NO: 532 - protein, 241 aa, Artificial Sequence
  MEMBRANE TYPE SERINE PROTEASE 1 (MT-SP1) protease domain I41E/F97V/F99L/C122S/G151N/Q175L/Q192S
VVGGTDADEGEWPWQVSLHALGQGHECGASLISPNWLVSAAHCYIDDRGFRYSDPTQWTAFLGLHDQSQRSAPGVQERRLKRIISHPFFNDVTLDYDIALLELEKPAEYSSMVRPISLPDASHVFPAGKAIWVTGWGHTQYGGTNALILQKGEIRVINQTTCENLLPQLITPRMMCVGFLSGGVDSCSGDSGGPLSSVEADGRIFQAGVVSWGDGCAQRNKPGVYTRLPLFRDWIKENTGV

SEQ ID NO: 533 - protein, 241 aa, Artificial Sequence
  MEMBRANE TYPE SERINE PROTEASE 1 (MT-SP1) protease domain F97R/F99L/C122S/G151Q/Q175R/Q192V/D217L
VVGGTDADEGEWPWQVSLHALGQGHICGASLISPNWLVSAAHCYIDDRGFRYSDPTQWTAFLGLHDQSQRSAPGVQERRLKRIISHPFFNDRTLDYDIALLELEKPAEYSSMVRPISLPDASHVFPAGKAIWVTGWGHTQYGGTQALILQKGEIRVINQTTCENLLPQRITPRMMCVGFLSGGVDSCVGDSGGPLSSVEADGRIFQAGVVSWGLGCAQRNKPGVYTRLPLFRDWIKENTGV

SEQ ID NO: 534 - protein, 241 aa, Artificial Sequence
  MEMBRANE TYPE SERINE PROTEASE 1 (MT-SP1) protease domain I41D/F99L/C122S/G151Q/Q175R/Q192V/D217L
VVGGTDADEGEWPWQVSLHALGQGHDCGASLISPNWLVSAAHCYIDDRGFRYSDPTQWTAFLGLHDQSQRSAPGVQERRLKRIISHPFFNDFTLDYDIALLELEKPAEYSSMVRPISLPDASHVFPAGKAIWVTGWGHTQYGGTQALILQKGEIRVINQTTCENLLPQRITPRMMCVGFLSGGVDSCVGDSGGPLSSVEADGRIFQAGVVSWGLGCAQRNKPGVYTRLPLFRDWIKENTGV

SEQ ID NO: 535 - protein, 241 aa, Artificial Sequence
  MEMBRANE TYPE SERINE PROTEASE 1 (MT-SP1) protease domain I41D/F97R/F99L/C122S/Q175R/Q192V/D217L
VVGGTDADEGEWPWQVSLHALGQGHDCGASLISPNWLVSAAHCYIDDRGFRYSDPTQWTAFLGLHDQSQRSAPGVQERRLKRIISHPFFNDRTLDYDIALLELEKPAEYSSMVRPISLPDASHVFPAGKAIWVTGWGHTQYGGTGALILQKGEIRVINQTTCENLLPQRITPRMMCVGFLSGGVDSCVGDSGGPLSSVEADGRIFQAGVVSWGLGCAQRNKPGVYTRLPLFRDWIKENTGV

SEQ ID NO: 536 - protein, 241 aa, Artificial Sequence
  MEMBRANE TYPE SERINE PROTEASE 1 (MT-SP1) protease domain I41D/F97R/F99L/C122S/G151Q/Q192V/D217L
VVGGTDADEGEWPWQVSLHALGQGHDCGASLISPNWLVSAAHCYIDDRGFRYSDPTQWTAFLGLHDQSQRSAPGVQERRLKRIISHPFFNDRTLDYDIALLELEKPAEYSSMVRPISLPDASHVFPAGKAIWVTGWGHTQYGGTQALILQKGEIRVINQTTCENLLPQQITPRMMCVGFLSGGVDSCVGDSGGPLSSVEADGRIFQAGVVSWGLGCAQRNKPGVYTRLPLFRDWIKENTGV

SEQ ID NO: 537 - protein, 241 aa, Artificial Sequence
  MEMBRANE TYPE SERINE PROTEASE 1 (MT-SP1) protease domain I41D/F97R/F99L/C122S/G151Q/Q175R/D217L
VVGGTDADEGEWPWQVSLHALGQGHDCGASLISPNWLVSAAHCYIDDRGFRYSDPTQWTAFLGLHDQSQRSAPGVQERRLKRIISHPFFNDRTLDYDIALLELEKPAEYSSMVRPISLPDASHVFPAGKAIWVTGWGHTQYGGTQALILQKGEIRVINQTTCENLLPQRITPRMMCVGFLSGGVDSCQGDSGGPLSSVEADGRIFQAGVVSWGLGCAQRNKPGVYTRLPLFRDWIKENTGV

SEQ ID NO: 538 - protein, 241 aa, Artificial Sequence
  MEMBRANE TYPE SERINE PROTEASE 1 (MT-SP1) protease domain I41D/F97R/F99L/C122S/G151Q/Q175R/Q192V
VVGGTDADEGEWPWQVSLHALGQGHDCGASLISPNWLVSAAHCYIDDRGFRYSDPTQWTAFLGLHDQSQRSAPGVQERRLKRIISHPFFNDRTLDYDIALLELEKPAEYSSMVRPISLPDASHVFPAGKAIWVTGWGHTQYGGTQALILQKGEIRVINQTTCENLLPQRITPRMMCVGFLSGGVDSCVGDSGGPLSSVEADGRIFQAGVVSWGDGCAQRNKPGVYTRLPLFRDWIKENTGV

SEQ ID NO: 539 - protein, 241 aa, Artificial Sequence
  MEMBRANE TYPE SERINE PROTEASE 1 (MT-SP1) protease domain I41E/F97R/F99L/C122S/G151Q/Q175G/Q192T
VVGGTDADEGEWPWQVSLHALGQGHECGASLISPNWLVSAAHCYIDDRGFRYSDPTQWTAFLGLHDQSQRSAPGVQERRLKRIISHPFFNDRTLDYDIALLELEKPAEYSSMVRPISLPDASHVFPAGKAIWVTGWGHTQYGGTQALILQKGEIRVINQTTCENLLPQGITPRMMCVGFLSGGVDSCTGDSGGPLSSVEADGRIFQAGVVSWGDGCAQRNKPGVYTRLPLFRDWIKENTGV

SEQ ID NO: 540 - protein, 241 aa, Artificial Sequence
  MEMBRANE TYPE SERINE PROTEASE 1 (MT-SP1) protease domain I41D/F99L/C122S/G151N/Q175S/Q192T/D217A
VVGGTDADEGEWPWQVSLHALGQGHDCGASLISPNWLVSAAHCYIDDRGFRYSDPTQWTAFLGLHDQSQRSAPGVQERRLKRIISHPFFNDFTLDYDIALLELEKPAEYSSMVRPISLPDASHVFPAGKAIWVTGWGHTQYGGTNALILQKGEIRVINQTTCENLLPQSITPRMMCVGFLSGGVDSCTGDSGGPLSSVEADGRIFQAGVVSWGAGCAQRNKPGVYTRLPLFRDWIKENTGV

SEQ ID NO: 541 - protein, 241 aa, Artificial Sequence
  MEMBRANE TYPE SERINE PROTEASE 1 (MT-SP1) protease domain I41D/F97T/F99L/C122S/Q175S/Q192T/D217A
VVGGTDADEGEWPWQVSLHALGQGHDCGASLISPNWLVSAAHCYIDDRGFRYSDPTQWTAFLGLHDQSQRSAPGVQERRLKRIISHPFFNDTTLDYDIALLELEKPAEYSSMVRPISLPDASHVFPAGKAIWVTGWGHTQYGGTGALILQKGEIRVINQTTCENLLPQSITPRMMCVGFLSGGVDSCTGDSGGPLSSVEADGRIFQAGVVSWGAGCAQRNKPGVYTRLPLFRDWIKENTGV

SEQ ID NO: 542 - protein, 241 aa, Artificial Sequence
  MEMBRANE TYPE SERINE PROTEASE 1 (MT-SP1) protease domain I41D/F97T/F99L/C122S/G151N/Q192T/D217A
VVGGTDADEGEWPWQVSLHALGQGHDCGASLISPNWLVSAAHCYIDDRGFRYSDPTQWTAFLGLHDQSQRSAPGVQERRLKRIISHPFFNDTTLDYDIALLELEKPAEYSSMVRPISLPDASHVFPAGKAIWVTGWGHTQYGGTNALILQKGEIRVINQTTCENLLPQQITPRMMCVGFLSGGVDSCTGDSGGPLSSVEADGRIFQAGVVSWGAGCAQRNKPGVYTRLPLFRDWIKENTGV

SEQ ID NO: 543 - protein, 241 aa, Artificial Sequence
  MEMBRANE TYPE SERINE PROTEASE 1 (MT-SP1) protease domain I41D/F97T/F99L/C122S/G151N/Q175S/D217A
VVGGTDADEGEWPWQVSLHALGQGHDCGASLISPNWLVSAAHCYIDDRGFRYSDPTQWTAFLGLHDQSQRSAPGVQERRLKRIISHPFFNDTTLDYDIALLELEKPAEYSSMVRPISLPDASHVFPAGKAIWVTGWGHTQYGGTNALILQKGEIRVINQTTCENLLPQSITPRMMCVGFLSGGVDSCQGDSGGPLSSVEADGRIFQAGVVSWGAGCAQRNKPGVYTRLPLFRDWIKENTGV

SEQ ID NO: 544 - protein, 241 aa, Artificial Sequence
  MEMBRANE TYPE SERINE PROTEASE 1 (MT-SP1) protease domain I41D/F97T/F99L/C122S/G151N/Q175S/Q192T
VVGGTDADEGEWPWQVSLHALGQGHDCGASLISPNWLVSAAHCYIDDRGFRYSDPTQWTAFLGLHDQSQRSAPGVQERRLKRIISHPFFNDTTLDYDIALLELEKPAEYSSMVRPISLPDASHVFPAGKAIWVTGWGHTQYGGTNALILQKGEIRVINQTTCENLLPQSITPRMMCVGFLSGGVDSCTGDSGGPLSSVEADGRIFQAGVVSWGDGCAQRNKPGVYTRLPLFRDWIKENTGV

SEQ ID NO: 545 - protein, 241 aa, Artificial Sequence
  MEMBRANE TYPE SERINE PROTEASE 1 (MT-SP1) protease domain F97T/F99L/C122S/G151N/Q175S/Q192T/D217A
VVGGTDADEGEWPWQVSLHALGQGHICGASLISPNWLVSAAHCYIDDRGFRYSDPTQWTAFLGLHDQSQRSAPGVQERRLKRIISHPFFNDTTLDYDIALLELEKPAEYSSMVRPISLPDASHVFPAGKAIWVTGWGHTQYGGTNALILQKGEIRVINQTTCENLLPQSITPRMMCVGFLSGGVDSCTGDSGGPLSSVEADGRIFQAGVVSWGAGCAQRNKPGVYTRLPLFRDWIKENTGV

SEQ ID NO: 546 - protein, 241 aa, Artificial Sequence
  MEMBRANE TYPE SERINE PROTEASE 1 (MT-SP1) protease domain I41S/F97Q/F99L/C122S/Q175W/Q192V/D217R
VVGGTDADEGEWPWQVSLHALGQGHSCGASLISPNWLVSAAHCYIDDRGFRYSDPTQWTAFLGLHDQSQRSAPGVQERRLKRIISHPFFNDQTLDYDIALLELEKPAEYSSMVRPISLPDASHVFPAGKAIWVTGWGHTQYGGTGALILQKGEIRVINQTTCENLLPQWITPRMMCVGFLSGGVDSCVGDSGGPLSSVEADGRIFQAGVVSWGRGCAQRNKPGVYTRLPLFRDWIKENTGV

SEQ ID NO: 547 - protein, 241 aa, Artificial Sequence
  MEMBRANE TYPE SERINE PROTEASE 1 (MT-SP1) protease domain I41G/F97L/F99L/C122S/G151N/Q192V/D217L
VVGGTDADEGEWPWQVSLHALGQGHGCGASLISPNWLVSAAHCYIDDRGFRYSDPTQWTAFLGLHDQSQRSAPGVQERRLKRIISHPFFNDLTLDYDIALLELEKPAEYSSMVRPISLPDASHVFPAGKAIWVTGWGHTQYGGTNALILQKGEIRVINQTTCENLLPQQITPRMMCVGFLSGGVDSCVGDSGGPLSSVEADGRIFQAGVVSWGLGCAQRNKPGVYTRLPLFRDWIKENTGV

SEQ ID NO: 548 - protein, 241 aa, Artificial Sequence
  MEMBRANE TYPE SERINE PROTEASE 1 (MT-SP1) protease domain I41G/F97A/F99L/C122S/G151N/Q175M/Q192S
VVGGTDADEGEWPWQVSLHALGQGHGCGASLISPNWLVSAAHCYIDDRGFRYSDPTQWTAFLGLHDQSQRSAPGVQERRLKRIISHPFFNDATLDYDIALLELEKPAEYSSMVRPISLPDASHVFPAGKAIWVTGWGHTQYGGTNALILQKGEIRVINQTTCENLLPQMITPRMMCVGFLSGGVDSCSGDSGGPLSSVEADGRIFQAGVVSWGDGCAQRNKPGVYTRLPLFRDWIKENTGV

SEQ ID NO: 549 - protein, 241 aa, Artificial Sequence
  MEMBRANE TYPE SERINE PROTEASE 1 (MT-SP1) protease domain I41G/F97V/F99L/C122S/G151N/Q192T/D217V
VVGGTDADEGEWPWQVSLHALGQGHGCGASLISPNWLVSAAHCYIDDRGFRYSDPTQWTAFLGLHDQSQRSAPGVQERRLKRIISHPFFNDVTLDYDIALLELEKPAEYSSMVRPISLPDASHVFPAGKAIWVTGWGHTQYGGTNALILQKGEIRVINQTTCENLLPQQITPRMMCVGFLSGGVDSCTGDSGGPLSSVEADGRIFQAGVVSWGVGCAQRNKPGVYTRLPLFRDWIKENTGV

SEQ ID NO: 550 - protein, 241 aa, Artificial Sequence
  MEMBRANE TYPE SERINE PROTEASE 1 (MT-SP1) protease domain I41D/F97R/F99L/C122S/Q175L/Q192T/D217I
VVGGTDADEGEWPWQVSLHALGQGHDCGASLISPNWLVSAAHCYIDDRGFRYSDPTQWTAFLGLHDQSQRSAPGVQERRLKRIISHPFFNDRTLDYDIALLELEKPAEYSSMVRPISLPDASHVFPAGKAIWVTGWGHTQYGGTGALILQKGEIRVINQTTCENLLPQLITPRMMCVGFLSGGVDSCTGDSGGPLSSVEADGRIFQAGVVSWGIGCAQRNKPGVYTRLPLFRDWIKENTGV

SEQ ID NO: 551 - protein, 241 aa, Artificial Sequence
  MEMBRANE TYPE SERINE PROTEASE 1 (MT-SP1) protease domain I41E/F97S/F99L/C122S/Q175L/Q192V/D217A
VVGGTDADEGEWPWQVSLHALGQGHECGASLISPNWLVSAAHCYIDDRGFRYSDPTQWTAFLGLHDQSQRSAPGVQERRLKRIISHPFFNDSTLDYDIALLELEKPAEYSSMVRPISLPDASHVFPAGKAIWVTGWGHTQYGGTGALILQKGEIRVINQTTCENLLPQLITPRMMCVGFLSGGVDSCVGDSGGPLSSVEADGRIFQAGVVSWGAGCAQRNKPGVYTRLPLFRDWIKENTGV

SEQ ID NO: 552 - protein, 241 aa, Artificial Sequence
  MEMBRANE TYPE SERINE PROTEASE 1 (MT-SP1) protease domain F97L/F99L/C122S/Q175K/Q192V/D217M
VVGGTDADEGEWPWQVSLHALGQGHICGASLISPNWLVSAAHCYIDDRGFRYSDPTQWTAFLGLHDQSQRSAPGVQERRLKRIISHPFFNDLTLDYDIALLELEKPAEYSSMVRPISLPDASHVFPAGKAIWVTGWGHTQYGGTGALILQKGEIRVINQTTCENLLPQKITPRMMCVGFLSGGVDSCVGDSGGPLSSVEADGRIFQAGVVSWGMGCAQRNKPGVYTRLPLFRDWIKENTGV

SEQ ID NO: 553 - protein, 241 aa, Artificial Sequence
  MEMBRANE TYPE SERINE PROTEASE 1 (MT-SP1) protease domain F97E/F99L/C122S/G151A/Q192V
VVGGTDADEGEWPWQVSLHALGQGHICGASLISPNWLVSAAHCYIDDRGFRYSDPTQWTAFLGLHDQSQRSAPGVQERRLKRIISHPFFNDETLDYDIALLELEKPAEYSSMVRPISLPDASHVFPAGKAIWVTGWGHTQYGGTAALILQKGEIRVINQTTCENLLPQQITPRMMCVGFLSGGVDSCVGDSGGPLSSVEADGRIFQAGVVSWGDGCAQRNKPGVYTRLPLFRDWIKENTGV

SEQ ID NO: 554 - protein, 241 aa, Artificial Sequence
  MEMBRANE TYPE SERINE PROTEASE 1 (MT-SP1) protease domain F97E/F99L/C122S/Q175H/Q192V/D217P
VVGGTDADEGEWPWQVSLHALGQGHICGASLISPNWLVSAAHCYIDDRGFRYSDPTQWTAFLGLHDQSQRSAPGVQERRLKRIISHPFFNDETLDYDIALLELEKPAEYSSMVRPISLPDASHVFPAGKAIWVTGWGHTQYGGTGALILQKGEIRVINQTTCENLLPQHITPRMMCVGFLSGGVDSCVGDSGGPLSSVEADGRIFQAGVVSWGPGCAQRNKPGVYTRLPLFRDWIKENTGV

SEQ ID NO: 555 - protein, 242 aa, Artificial Sequence
  MEMBRANE TYPE SERINE PROTEASE 1 (MT-SP1) protease domain F97R/ins97aI/T98P/C122S/Q175M/Q192V/D217I
VVGGTDADEGEWPWQVSLHALGQGHICGASLISPNWLVSAAHCYIDDRGFRYSDPTQWTAFLGLHDQSQRSAPGVQERRLKRIISHPFFNDRIPFDYDIALLELEKPAEYSSMVRPISLPDASHVFPAGKAIWVTGWGHTQYGGTGALILQKGEIRVINQTTCENLLPQMITPRMMCVGFLSGGVDSCVGDSGGPLSSVEADGRIFQAGVVSWGIGCAQRNKPGVYTRLPLFRDWIKENTGV

SEQ ID NO: 556 - protein, 241 aa, Artificial Sequence
  MEMBRANE TYPE SERINE PROTEASE 1 (MT-SP1) protease domain I41D/F99L/C122S/G151N/Q192T/D217A
VVGGTDADEGEWPWQVSLHALGQGHDCGASLISPNWLVSAAHCYIDDRGFRYSDPTQWTAFLGLHDQSQRSAPGVQERRLKRIISHPFFNDFTLDYDIALLELEKPAEYSSMVRPISLPDASHVFPAGKAIWVTGWGHTQYGGTNALILQKGEIRVINQTTCENLLPQQITPRMMCVGFLSGGVDSCTGDSGGPLSSVEADGRIFQAGVVSWGAGCAQRNKPGVYTRLPLFRDWIKENTGV

SEQ ID NO: 557 - protein, 241 aa, Artificial Sequence
  MEMBRANE TYPE SERINE PROTEASE 1 (MT-SP1) protease domain I41D/F99L/C122S/G151N/Q175S/Q192T
VVGGTDADEGEWPWQVSLHALGQGHDCGASLISPNWLVSAAHCYIDDRGFRYSDPTQWTAFLGLHDQSQRSAPGVQERRLKRIISHPFFNDFTLDYDIALLELEKPAEYSSMVRPISLPDASHVFPAGKAIWVTGWGHTQYGGTNALILQKGEIRVINQTTCENLLPQSITPRMMCVGFLSGGVDSCTGDSGGPLSSVEADGRIFQAGVVSWGDGCAQRNKPGVYTRLPLFRDWIKENTGV

SEQ ID NO: 558 - protein, 241 aa, Artificial Sequence
  MEMBRANE TYPE SERINE PROTEASE 1 (MT-SP1) protease domain I41D/F97T/F99L/C122S/G151N/Q192T
VVGGTDADEGEWPWQVSLHALGQGHDCGASLISPNWLVSAAHCYIDDRGFRYSDPTQWTAFLGLHDQSQRSAPGVQERRLKRIISHPFFNDTTLDYDIALLELEKPAEYSSMVRPISLPDASHVFPAGKAIWVTGWGHTQYGGTNALILQKGEIRVINQTTCENLLPQQITPRMMCVGFLSGGVDSCTGDSGGPLSSVEADGRIFQAGVVSWGDGCAQRNKPGVYTRLPLFRDWIKENTGV

SEQ ID NO: 559 - protein, 241 aa, Artificial Sequence
  MEMBRANE TYPE SERINE PROTEASE 1 (MT-SP1) protease domain I41D/F99L/C122S/G151N/Q192T
VVGGTDADEGEWPWQVSLHALGQGHDCGASLISPNWLVSAAHCYIDDRGFRYSDPTQWTAFLGLHDQSQRSAPGVQERRLKRIISHPFFNDFTLDYDIALLELEKPAEYSSMVRPISLPDASHVFPAGKAIWVTGWGHTQYGGTNALILQKGEIRVINQTTCENLLPQQITPRMMCVGFLSGGVDSCTGDSGGPLSSVEADGRIFQAGVVSWGDGCAQRNKPGVYTRLPLFRDWIKENTGV

SEQ ID NO: 560 - protein, 241 aa, Artificial Sequence
  MEMBRANE TYPE SERINE PROTEASE 1 (MT-SP1) protease domain I41D/F99L/C122S/Q175S/Q192T
VVGGTDADEGEWPWQVSLHALGQGHDCGASLISPNWLVSAAHCYIDDRGFRYSDPTQWTAFLGLHDQSQRSAPGVQERRLKRIISHPFFNDFTLDYDIALLELEKPAEYSSMVRPISLPDASHVFPAGKAIWVTGWGHTQYGGTGALILQKGEIRVINQTTCENLLPQSITPRMMCVGFLSGGVDSCTGDSGGPLSSVEADGRIFQAGVVSWGDGCAQRNKPGVYTRLPLFRDWIKENTGV

SEQ ID NO: 561 - protein, 241 aa, Artificial Sequence
  MEMBRANE TYPE SERINE PROTEASE 1 (MT-SP1) protease domain I41D/F99L/C122S/Q192T
VVGGTDADEGEWPWQVSLHALGQGHDCGASLISPNWLVSAAHCYIDDRGFRYSDPTQWTAFLGLHDQSQRSAPGVQERRLKRIISHPFFNDFTLDYDIALLELEKPAEYSSMVRPISLPDASHVFPAGKAIWVTGWGHTQYGGTGALILQKGEIRVINQTTCENLLPQQITPRMMCVGFLSGGVDSCTGDSGGPLSSVEADGRIFQAGVVSWGDGCAQRNKPGVYTRLPLFRDWIKENTGV

SEQ ID NO: 562 - protein, 241 aa, Artificial Sequence
  MEMBRANE TYPE SERINE PROTEASE 1 (MT-SP1) protease domain Q38R/I41G/Y60gG/F99M/C122S/G151N/Q192R
VVGGTDADEGEWPWQVSLHALGRGHGCGASLISPNWLVSAAHCYIDDRGFRGSDPTQWTAFLGLHDQSQRSAPGVQERRLKRIISHPFFNDFTMDYDIALLELEKPAEYSSMVRPISLPDASHVFPAGKAIWVTGWGHTQYGGTNALILQKGEIRVINQTTCENLLPQQITPRMMCVGFLSGGVDSCRGDSGGPLSSVEADGRIFQAGVVSWGDGCAQRNKPGVYTRLPLFRDWIKENTGV

SEQ ID NO: 563 - protein, 241 aa, Artificial Sequence
  MEMBRANE TYPE SERINE PROTEASE 1 (MT-SP1) protease domain Q38K/I41G/Y60gG/F99L/C122S/G151N/Q192H
VVGGTDADEGEWPWQVSLHALGKGHGCGASLISPNWLVSAAHCYIDDRGFRGSDPTQWTAFLGLHDQSQRSAPGVQERRLKRIISHPFFNDFTLDYDIALLELEKPAEYSSMVRPISLPDASHVFPAGKAIWVTGWGHTQYGGTNALILQKGEIRVINQTTCENLLPQQITPRMMCVGFLSGGVDSCHGDSGGPLSSVEADGRIFQAGVVSWGDGCAQRNKPGVYTRLPLFRDWIKENTGV

SEQ ID NO: 564 - protein, 241 aa, Artificial Sequence
  MEMBRANE TYPE SERINE PROTEASE 1 (MT-SP1) protease domain Q38L/I41R/Y60gF/F99L/C122S/G151N/Q192A
VVGGTDADEGEWPWQVSLHALGLGHRCGASLISPNWLVSAAHCYIDDRGFRFSDPTQWTAFLGLHDQSQRSAPGVQERRLKRIISHPFFNDFTLDYDIALLELEKPAEYSSMVRPISLPDASHVFPAGKAIWVTGWGHTQYGGTNALILQKGEIRVINQTTCENLLPQQITPRMMCVGFLSGGVDSCAGDSGGPLSSVEADGRIFQAGVVSWGDGCAQRNKPGVYTRLPLFRDWIKENTGV

SEQ ID NO: 565 - protein, 241 aa, Artificial Sequence
  MEMBRANE TYPE SERINE PROTEASE 1 (MT-SP1) protease domain Q38K/I41D/Y60gG/F99L/C122S/G151N
VVGGTDADEGEWPWQVSLHALGKGHDCGASLISPNWLVSAAHCYIDDRGFRGSDPTQWTAFLGLHDQSQRSAPGVQERRLKRIISHPFFNDFTLDYDIALLELEKPAEYSSMVRPISLPDASHVFPAGKAIWVTGWGHTQYGGTNALILQKGEIRVINQTTCENLLPQQITPRMMCVGFLSGGVDSCQGDSGGPLSSVEADGRIFQAGVVSWGDGCAQRNKPGVYTRLPLFRDWIKENTGV

SEQ ID NO: 566 - protein, 241 aa, Artificial Sequence
  MEMBRANE TYPE SERINE PROTEASE 1 (MT-SP1) protease domain Q38R/I41R/Y60gF/F99L/C122S/G151N/Q192G
VVGGTDADEGEWPWQVSLHALGRGHRCGASLISPNWLVSAAHCYIDDRGFRFSDPTQWTAFLGLHDQSQRSAPGVQERRLKRIISHPFFNDFTLDYDIALLELEKPAEYSSMVRPISLPDASHVFPAGKAIWVTGWGHTQYGGTNALILQKGEIRVINQTTCENLLPQQITPRMMCVGFLSGGVDSCGGDSGGPLSSVEADGRIFQAGVVSWGDGCAQRNKPGVYTRLPLFRDWIKENTGV

SEQ ID NO: 567 - protein, 241 aa, Artificial Sequence
  MEMBRANE TYPE SERINE PROTEASE 1 (MT-SP1) protease domain Q38S/I41S/Y60gW/F99L/C122S/G151D/Q192T
VVGGTDADEGEWPWQVSLHALGSGHSCGASLISPNWLVSAAHCYIDDRGFRWSDPTQWTAFLGLHDQSQRSAPGVQERRLKRIISHPFFNDFTLDYDIALLELEKPAEYSSMVRPISLPDASHVFPAGKAIWVTGWGHTQYGGTDALILQKGEIRVINQTTCENLLPQQITPRMMCVGFLSGGVDSCTGDSGGPLSSVEADGRIFQAGVVSWGDGCAQRNKPGVYTRLPLFRDWIKENTGV

SEQ ID NO: 568 - protein, 241 aa, Artificial Sequence
  MEMBRANE TYPE SERINE PROTEASE 1 (MT-SP1) protease domain Q38K/I41G/Y60gW/F99L/C122S/G151N/Q192A
VVGGTDADEGEWPWQVSLHALGKGHGCGASLISPNWLVSAAHCYIDDRGFRWSDPTQWTAFLGLHDQSQRSAPGVQERRLKRIISHPFFNDFTLDYDIALLELEKPAEYSSMVRPISLPDASHVFPAGKAIWVTGWGHTQYGGTNALILQKGEIRVINQTTCENLLPQQITPRMMCVGFLSGGVDSCAGDSGGPLSSVEADGRIFQAGVVSWGDGCAQRNKPGVYTRLPLFRDWIKENTGV

SEQ ID NO: 569 - protein, 241 aa, Artificial Sequence
  MEMBRANE TYPE SERINE PROTEASE 1 (MT-SP1) protease domain Q38H/I41S/Y60gW/C122S/G151H/Q192A
VVGGTDADEGEWPWQVSLHALGHGHSCGASLISPNWLVSAAHCYIDDRGFRWSDPTQWTAFLGLHDQSQRSAPGVQERRLKRIISHPFFNDFTFDYDIALLELEKPAEYSSMVRPISLPDASHVFPAGKAIWVTGWGHTQYGGTHALILQKGEIRVINQTTCENLLPQQITPRMMCVGFLSGGVDSCAGDSGGPLSSVEADGRIFQAGVVSWGDGCAQRNKPGVYTRLPLFRDWIKENTGV

SEQ ID NO: 570 - protein, 241 aa, Artificial Sequence
  MEMBRANE TYPE SERINE PROTEASE 1 (MT-SP1) protease domain Q38K/I41S/Y60gW/F99L/C122S/G151N/Q192G
VVGGTDADEGEWPWQVSLHALGKGHSCGASLISPNWLVSAAHCYIDDRGFRWSDPTQWTAFLGLHDQSQRSAPGVQERRLKRIISHPFFNDFTLDYDIALLELEKPAEYSSMVRPISLPDASHVFPAGKAIWVTGWGHTQYGGTNALILQKGEIRVINQTTCENLLPQQITPRMMCVGFLSGGVDSCGGDSGGPLSSVEADGRIFQAGVVSWGDGCAQRNKPGVYTRLPLFRDWIKENTGV

SEQ ID NO: 571 - protein, 241 aa, Artificial Sequence
  MEMBRANE TYPE SERINE PROTEASE 1 (MT-SP1) protease domain Q38F/I41S/Y60gA/C122S/G151N/Q192R
VVGGTDADEGEWPWQVSLHALGFGHSCGASLISPNWLVSAAHCYIDDRGFRASDPTQWTAFLGLHDQSQRSAPGVQERRLKRIISHPFFNDFTFDYDIALLELEKPAEYSSMVRPISLPDASHVFPAGKAIWVTGWGHTQYGGTNALILQKGEIRVINQTTCENLLPQQITPRMMCVGFLSGGVDSCRGDSGGPLSSVEADGRIFQAGVVSWGDGCAQRNKPGVYTRLPLFRDWIKENTGV

SEQ ID NO: 572 - protein, 241 aa, Artificial Sequence
  MEMBRANE TYPE SERINE PROTEASE 1 (MT-SP1) protease domain Q38R/I41S/Y60gW/F99L/C122S/G151N/Q192E
VVGGTDADEGEWPWQVSLHALGRGHSCGASLISPNWLVSAAHCYIDDRGFRWSDPTQWTAFLGLHDQSQRSAPGVQERRLKRIISHPFFNDFTLDYDIALLELEKPAEYSSMVRPISLPDASHVFPAGKAIWVTGWGHTQYGGTNALILQKGEIRVINQTTCENLLPQQITPRMMCVGFLSGGVDSCEGDSGGPLSSVEADGRIFQAGVVSWGDGCAQRNKPGVYTRLPLFRDWIKENTGV

SEQ ID NO: 573 - protein, 241 aa, Artificial Sequence
  MEMBRANE TYPE SERINE PROTEASE 1 (MT-SP1) protease domain Q38K/I41R/Y60gG/F99L/C122S/G151N/Q192G
VVGGTDADEGEWPWQVSLHALGKGHRCGASLISPNWLVSAAHCYIDDRGFRGSDPTQWTAFLGLHDQSQRSAPGVQERRLKRIISHPFFNDFTLDYDIALLELEKPAEYSSMVRPISLPDASHVFPAGKAIWVTGWGHTQYGGTNALILQKGEIRVINQTTCENLLPQQITPRMMCVGFLSGGVDSCGGDSGGPLSSVEADGRIFQAGVVSWGDGCAQRNKPGVYTRLPLFRDWIKENTGV

SEQ ID NO: 574 - protein, 241 aa, Artificial Sequence
  MEMBRANE TYPE SERINE PROTEASE 1 (MT-SP1) protease domain Q38R/I41R/F99L/C122S/G151N/Q192G
VVGGTDADEGEWPWQVSLHALGRGHRCGASLISPNWLVSAAHCYIDDRGFRYSDPTQWTAFLGLHDQSQRSAPGVQERRLKRIISHPFFNDFTLDYDIALLELEKPAEYSSMVRPISLPDASHVFPAGKAIWVTGWGHTQYGGTNALILQKGEIRVINQTTCENLLPQQITPRMMCVGFLSGGVDSCGGDSGGPLSSVEADGRIFQAGVVSWGDGCAQRNKPGVYTRLPLFRDWIKENTGV

SEQ ID NO: 575 - protein, 241 aa, Artificial Sequence
  MEMBRANE TYPE SERINE PROTEASE 1 (MT-SP1) protease domain Q38R/I41R/Y60gL/F99L/C122S/G151N/Q192G
VVGGTDADEGEWPWQVSLHALGRGHRCGASLISPNWLVSAAHCYIDDRGFRLSDPTQWTAFLGLHDQSQRSAPGVQERRLKRIISHPFFNDFTLDYDIALLELEKPAEYSSMVRPISLPDASHVFPAGKAIWVTGWGHTQYGGTNALILQKGEIRVINQTTCENLLPQQITPRMMCVGFLSGGVDSCGGDSGGPLSSVEADGRIFQAGVVSWGDGCAQRNKPGVYTRLPLFRDWIKENTGV

SEQ ID NO: 576 - protein, 241 aa, Artificial Sequence
  MEMBRANE TYPE SERINE PROTEASE 1 (MT-SP1) protease domain I41E/C122S/G151N/Q175L/Q192A
VVGGTDADEGEWPWQVSLHALGQGHECGASLISPNWLVSAAHCYIDDRGFRYSDPTQWTAFLGLHDQSQRSAPGVQERRLKRIISHPFFNDFTFDYDIALLELEKPAEYSSMVRPISLPDASHVFPAGKAIWVTGWGHTQYGGTNALILQKGEIRVINQTTCENLLPQLITPRMMCVGFLSGGVDSCAGDSGGPLSSVEADGRIFQAGVVSWGDGCAQRNKPGVYTRLPLFRDWIKENTGV

SEQ ID NO: 577 - protein, 241 aa, Artificial Sequence
  MEMBRANE TYPE SERINE PROTEASE 1 (MT-SP1) protease domain I41S/F99M/C122S/G151N/Q175L/Q192G
VVGGTDADEGEWPWQVSLHALGQGHSCGASLISPNWLVSAAHCYIDDRGFRYSDPTQWTAFLGLHDQSQRSAPGVQERRLKRIISHPFFNDFTMDYDIALLELEKPAEYSSMVRPISLPDASHVFPAGKAIWVTGWGHTQYGGTNALILQKGEIRVINQTTCENLLPQLITPRMMCVGFLSGGVDSCGGDSGGPLSSVEADGRIFQAGVVSWGDGCAQRNKPGVYTRLPLFRDWIKENTGV

SEQ ID NO: 578 - protein, 241 aa, Artificial Sequence
  MEMBRANE TYPE SERINE PROTEASE 1 (MT-SP1) protease domain I41E/F99L/C122S/G151N/Q175L/Q192A
VVGGTDADEGEWPWQVSLHALGQGHECGASLISPNWLVSAAHCYIDDRGFRYSDPTQWTAFLGLHDQSQRSAPGVQERRLKRIISHPFFNDFTLDYDIALLELEKPAEYSSMVRPISLPDASHVFPAGKAIWVTGWGHTQYGGTNALILQKGEIRVINQTTCENLLPQLITPRMMCVGFLSGGVDSCAGDSGGPLSSVEADGRIFQAGVVSWGDGCAQRNKPGVYTRLPLFRDWIKENTGV

SEQ ID NO: 579 - protein, 241 aa, Artificial Sequence
  MEMBRANE TYPE SERINE PROTEASE 1 (MT-SP1) protease domain I41S/F99L/C122S/G151H/Q175L/Q192V
VVGGTDADEGEWPWQVSLHALGQGHSCGASLISPNWLVSAAHCYIDDRGFRYSDPTQWTAFLGLHDQSQRSAPGVQERRLKRIISHPFFNDFTLDYDIALLELEKPAEYSSMVRPISLPDASHVFPAGKAIWVTGWGHTQYGGTHALILQKGEIRVINQTTCENLLPQLITPRMMCVGFLSGGVDSCVGDSGGPLSSVEADGRIFQAGVVSWGDGCAQRNKPGVYTRLPLFRDWIKENTGV

SEQ ID NO: 580 - protein, 241 aa, Artificial Sequence
  MEMBRANE TYPE SERINE PROTEASE 1 (MT-SP1) protease domain I41G/F99L/C122S/G151N/Q192A
VVGGTDADEGEWPWQVSLHALGQGHGCGASLISPNWLVSAAHCYIDDRGFRYSDPTQWTAFLGLHDQSQRSAPGVQERRLKRIISHPFFNDFTLDYDIALLELEKPAEYSSMVRPISLPDASHVFPAGKAIWVTGWGHTQYGGTNALILQKGEIRVINQTTCENLLPQQITPRMMCVGFLSGGVDSCAGDSGGPLSSVEADGRIFQAGVVSWGDGCAQRNKPGVYTRLPLFRDWIKENTGV

SEQ ID NO: 581 - protein, 241 aa, Artificial Sequence
  MEMBRANE TYPE SERINE PROTEASE 1 (MT-SP1) protease domain I41S/F99M/C122S/G151N/Q175G/Q192R
VVGGTDADEGEWPWQVSLHALGQGHSCGASLISPNWLVSAAHCYIDDRGFRYSDPTQWTAFLGLHDQSQRSAPGVQERRLKRIISHPFFNDFTMDYDIALLELEKPAEYSSMVRPISLPDASHVFPAGKAIWVTGWGHTQYGGTNALILQKGEIRVINQTTCENLLPQGITPRMMCVGFLSGGVDSCRGDSGGPLSSVEADGRIFQAGVVSWGDGCAQRNKPGVYTRLPLFRDWIKENTGV

SEQ ID NO: 582 - protein, 241 aa, Artificial Sequence
  MEMBRANE TYPE SERINE PROTEASE 1 (MT-SP1) protease domain I41E/F99L/C122S/G151N/Q175R/Q192H
VVGGTDADEGEWPWQVSLHALGQGHECGASLISPNWLVSAAHCYIDDRGFRYSDPTQWTAFLGLHDQSQRSAPGVQERRLKRIISHPFFNDFTLDYDIALLELEKPAEYSSMVRPISLPDASHVFPAGKAIWVTGWGHTQYGGTNALILQKGEIRVINQTTCENLLPQRITPRMMCVGFLSGGVDSCHGDSGGPLSSVEADGRIFQAGVVSWGDGCAQRNKPGVYTRLPLFRDWIKENTGV

SEQ ID NO: 583 - protein, 241 aa, Artificial Sequence
  MEMBRANE TYPE SERINE PROTEASE 1 (MT-SP1) protease domain I41S/F99M/C122S/G151N/Q175E/Q192R
VVGGTDADEGEWPWQVSLHALGQGHSCGASLISPNWLVSAAHCYIDDRGFRYSDPTQWTAFLGLHDQSQRSAPGVQERRLKRIISHPFFNDFTMDYDIALLELEKPAEYSSMVRPISLPDASHVFPAGKAIWVTGWGHTQYGGTNALILQKGEIRVINQTTCENLLPQEITPRMMCVGFLSGGVDSCRGDSGGPLSSVEADGRIFQAGVVSWGDGCAQRNKPGVYTRLPLFRDWIKENTGV

SEQ ID NO: 584 - protein, 241 aa, Artificial Sequence
  MEMBRANE TYPE SERINE PROTEASE 1 (MT-SP1) protease domain I41E/F99L/C122S/G151N/Q192V
VVGGTDADEGEWPWQVSLHALGQGHECGASLISPNWLVSAAHCYIDDRGFRYSDPTQWTAFLGLHDQSQRSAPGVQERRLKRIISHPFFNDFTLDYDIALLELEKPAEYSSMVRPISLPDASHVFPAGKAIWVTGWGHTQYGGTNALILQKGEIRVINQTTCENLLPQQITPRMMCVGFLSGGVDSCVGDSGGPLSSVEADGRIFQAGVVSWGDGCAQRNKPGVYTRLPLFRDWIKENTGV

SEQ ID NO: 585 - protein, 241 aa, Artificial Sequence
  MEMBRANE TYPE SERINE PROTEASE 1 (MT-SP1) protease domain I41E/F99L/C122S/G151N/Q192S
VVGGTDADEGEWPWQVSLHALGQGHECGASLISPNWLVSAAHCYIDDRGFRYSDPTQWTAFLGLHDQSQRSAPGVQERRLKRIISHPFFNDFTLDYDIALLELEKPAEYSSMVRPISLPDASHVFPAGKAIWVTGWGHTQYGGTNALILQKGEIRVINQTTCENLLPQQITPRMMCVGFLSGGVDSCSGDSGGPLSSVEADGRIFQAGVVSWGDGCAQRNKPGVYTRLPLFRDWIKENTGV

SEQ ID NO: 586 - protein, 241 aa, Artificial Sequence
  MEMBRANE TYPE SERINE PROTEASE 1 (MT-SP1) protease domain I41S/F99L/C122S/G151N/Q175P/Q192V
VVGGTDADEGEWPWQVSLHALGQGHSCGASLISPNWLVSAAHCYIDDRGFRYSDPTQWTAFLGLHDQSQRSAPGVQERRLKRIISHPFFNDFTLDYDIALLELEKPAEYSSMVRPISLPDASHVFPAGKAIWVTGWGHTQYGGTNALILQKGEIRVINQTTCENLLPQPITPRMMCVGFLSGGVDSCVGDSGGPLSSVEADGRIFQAGVVSWGDGCAQRNKPGVYTRLPLFRDWIKENTGV

SEQ ID NO: 587 - protein, 241 aa, Artificial Sequence
  MEMBRANE TYPE SERINE PROTEASE 1 (MT-SP1) protease domain I41E/F99L/C122S/G151N/Q175G/Q192T
VVGGTDADEGEWPWQVSLHALGQGHECGASLISPNWLVSAAHCYIDDRGFRYSDPTQWTAFLGLHDQSQRSAPGVQERRLKRIISHPFFNDFTLDYDIALLELEKPAEYSSMVRPISLPDASHVFPAGKAIWVTGWGHTQYGGTNALILQKGEIRVINQTTCENLLPQGITPRMMCVGFLSGGVDSCTGDSGGPLSSVEADGRIFQAGVVSWGDGCAQRNKPGVYTRLPLFRDWIKENTGV

SEQ ID NO: 588 - protein, 241 aa, Artificial Sequence
  MEMBRANE TYPE SERINE PROTEASE 1 (MT-SP1) protease domain I41S/C122S/G151N/Q175R/Q192R
VVGGTDADEGEWPWQVSLHALGQGHSCGASLISPNWLVSAAHCYIDDRGFRYSDPTQWTAFLGLHDQSQRSAPGVQERRLKRIISHPFFNDFTFDYDIALLELEKPAEYSSMVRPISLPDASHVFPAGKAIWVTGWGHTQYGGTNALILQKGEIRVINQTTCENLLPQRITPRMMCVGFLSGGVDSCRGDSGGPLSSVEADGRIFQAGVVSWGDGCAQRNKPGVYTRLPLFRDWIKENTGV

SEQ ID NO: 589 - protein, 241 aa, Artificial Sequence
  MEMBRANE TYPE SERINE PROTEASE 1 (MT-SP1) protease domain I41S/F99M/C122S/G151N/Q175P/Q192S
VVGGTDADEGEWPWQVSLHALGQGHSCGASLISPNWLVSAAHCYIDDRGFRYSDPTQWTAFLGLHDQSQRSAPGVQERRLKRIISHPFFNDFTMDYDIALLELEKPAEYSSMVRPISLPDASHVFPAGKAIWVTGWGHTQYGGTNALILQKGEIRVINQTTCENLLPQPITPRMMCVGFLSGGVDSCSGDSGGPLSSVEADGRIFQAGVVSWGDGCAQRNKPGVYTRLPLFRDWIKENTGV

SEQ ID NO: 590 - protein, 241 aa, Artificial Sequence
  MEMBRANE TYPE SERINE PROTEASE 1 (MT-SP1) protease domain I41S/C122S/G151N/Q175D/Q192R
VVGGTDADEGEWPWQVSLHALGQGHSCGASLISPNWLVSAAHCYIDDRGFRYSDPTQWTAFLGLHDQSQRSAPGVQERRLKRIISHPFFNDFTFDYDIALLELEKPAEYSSMVRPISLPDASHVFPAGKAIWVTGWGHTQYGGTNALILQKGEIRVINQTTCENLLPQDITPRMMCVGFLSGGVDSCRGDSGGPLSSVEADGRIFQAGVVSWGDGCAQRNKPGVYTRLPLFRDWIKENTGV

SEQ ID NO: 591 - protein, 241 aa, Artificial Sequence
  MEMBRANE TYPE SERINE PROTEASE 1 (MT-SP1) protease domain I41E/F99L/C122S/G151N/Q175R/Q192T
VVGGTDADEGEWPWQVSLHALGQGHECGASLISPNWLVSAAHCYIDDRGFRYSDPTQWTAFLGLHDQSQRSAPGVQERRLKRIISHPFFNDFTLDYDIALLELEKPAEYSSMVRPISLPDASHVFPAGKAIWVTGWGHTQYGGTNALILQKGEIRVINQTTCENLLPQRITPRMMCVGFLSGGVDSCTGDSGGPLSSVEADGRIFQAGVVSWGDGCAQRNKPGVYTRLPLFRDWIKENTGV

SEQ ID NO: 592 - protein, 241 aa, Artificial Sequence
  MEMBRANE TYPE SERINE PROTEASE 1 (MT-SP1) protease domain I41G/F99L/C122S/G151N/Q175R/Q192A
VVGGTDADEGEWPWQVSLHALGQGHGCGASLISPNWLVSAAHCYIDDRGFRYSDPTQWTAFLGLHDQSQRSAPGVQERRLKRIISHPFFNDFTLDYDIALLELEKPAEYSSMVRPISLPDASHVFPAGKAIWVTGWGHTQYGGTNALILQKGEIRVINQTTCENLLPQRITPRMMCVGFLSGGVDSCAGDSGGPLSSVEADGRIFQAGVVSWGDGCAQRNKPGVYTRLPLFRDWIKENTGV

SEQ ID NO: 593 - protein, 241 aa, Artificial Sequence
  MEMBRANE TYPE SERINE PROTEASE 1 (MT-SP1) protease domain F99L/C122S/G151N/Q192T
VVGGTDADEGEWPWQVSLHALGQGHICGASLISPNWLVSAAHCYIDDRGFRYSDPTQWTAFLGLHDQSQRSAPGVQERRLKRIISHPFFNDFTLDYDIALLELEKPAEYSSMVRPISLPDASHVFPAGKAIWVTGWGHTQYGGTNALILQKGEIRVINQTTCENLLPQQITPRMMCVGFLSGGVDSCTGDSGGPLSSVEADGRIFQAGVVSWGDGCAQRNKPGVYTRLPLFRDWIKENTGV

SEQ ID NO: 594 - protein, 241 aa, Artificial Sequence
  MEMBRANE TYPE SERINE PROTEASE 1 (MT-SP1) protease domain I41D/F99L/C122S/G151N
VVGGTDADEGEWPWQVSLHALGQGHDCGASLISPNWLVSAAHCYIDDRGFRYSDPTQWTAFLGLHDQSQRSAPGVQERRLKRIISHPFFNDFTLDYDIALLELEKPAEYSSMVRPISLPDASHVFPAGKAIWVTGWGHTQYGGTNALILQKGEIRVINQTTCENLLPQQITPRMMCVGFLSGGVDSCQGDSGGPLSSVEADGRIFQAGVVSWGDGCAQRNKPGVYTRLPLFRDWIKENTGV

SEQ ID NO: 595 - protein, 241 aa, Artificial Sequence
  MEMBRANE TYPE SERINE PROTEASE 1 (MT-SP1) protease domain I41S/F99L/C122S/Q175P/Q192V
VVGGTDADEGEWPWQVSLHALGQGHSCGASLISPNWLVSAAHCYIDDRGFRYSDPTQWTAFLGLHDQSQRSAPGVQERRLKRIISHPFFNDFTLDYDIALLELEKPAEYSSMVRPISLPDASHVFPAGKAIWVTGWGHTQYGGTGALILQKGEIRVINQTTCENLLPQPITPRMMCVGFLSGGVDSCVGDSGGPLSSVEADGRIFQAGVVSWGDGCAQRNKPGVYTRLPLFRDWIKENTGV

SEQ ID NO: 596 - protein, 241 aa, Artificial Sequence
  MEMBRANE TYPE SERINE PROTEASE 1 (MT-SP1) protease domain I41S/F99L/C122S/G151N/Q175P
VVGGTDADEGEWPWQVSLHALGQGHSCGASLISPNWLVSAAHCYIDDRGFRYSDPTQWTAFLGLHDQSQRSAPGVQERRLKRIISHPFFNDFTLDYDIALLELEKPAEYSSMVRPISLPDASHVFPAGKAIWVTGWGHTQYGGTNALILQKGEIRVINQTTCENLLPQPITPRMMCVGFLSGGVDSCQGDSGGPLSSVEADGRIFQAGVVSWGDGCAQRNKPGVYTRLPLFRDWIKENTGV

SEQ ID NO: 597 - protein, 241 aa, Artificial Sequence
  MEMBRANE TYPE SERINE PROTEASE 1 (MT-SP1) protease domain I41E/F99L/C122S/Q175G/Q192T
VVGGTDADEGEWPWQVSLHALGQGHECGASLISPNWLVSAAHCYIDDRGFRYSDPTQWTAFLGLHDQSQRSAPGVQERRLKRIISHPFFNDFTLDYDIALLELEKPAEYSSMVRPISLPDASHVFPAGKAIWVTGWGHTQYGGTGALILQKGEIRVINQTTCENLLPQGITPRMMCVGFLSGGVDSCTGDSGGPLSSVEADGRIFQAGVVSWGDGCAQRNKPGVYTRLPLFRDWIKENTGV

SEQ ID NO: 598 - protein, 241 aa, Artificial Sequence
  MEMBRANE TYPE SERINE PROTEASE 1 (MT-SP1) protease domain I41E/F99L/C122S/G151N/Q175G
VVGGTDADEGEWPWQVSLHALGQGHECGASLISPNWLVSAAHCYIDDRGFRYSDPTQWTAFLGLHDQSQRSAPGVQERRLKRIISHPFFNDFTLDYDIALLELEKPAEYSSMVRPISLPDASHVFPAGKAIWVTGWGHTQYGGTNALILQKGEIRVINQTTCENLLPQGITPRMMCVGFLSGGVDSCQGDSGGPLSSVEADGRIFQAGVVSWGDGCAQRNKPGVYTRLPLFRDWIKENTGV

SEQ ID NO: 599 - protein, 241 aa, Artificial Sequence
  MEMBRANE TYPE SERINE PROTEASE 1 (MT-SP1) protease domain I41D/Y59F/F99L/C122S/G151N/Q192T/V213A
VVGGTDADEGEWPWQVSLHALGQGHDCGASLISPNWLVSAAHCFIDDRGFRYSDPTQWTAFLGLHDQSQRSAPGVQERRLKRIISHPFFNDFTLDYDIALLELEKPAEYSSMVRPISLPDASHVFPAGKAIWVTGWGHTQYGGTNALILQKGEIRVINQTTCENLLPQQITPRMMCVGFLSGGVDSCTGDSGGPLSSVEADGRIFQAGVASWGDGCAQRNKPGVYTRLPLFRDWIKENTGV

SEQ ID NO: 600 - protein, 241 aa, Artificial Sequence
  MEMBRANE TYPE SERINE PROTEASE 1 (MT-SP1) protease domain I41D/G43A/F99L/C122S/G151N/Q192T/P232S/K239R
VVGGTDADEGEWPWQVSLHALGQGHDCAASLISPNWLVSAAHCYIDDRGFRYSDPTQWTAFLGLHDQSQRSAPGVQERRLKRIISHPFFNDFTLDYDIALLELEKPAEYSSMVRPISLPDASHVFPAGKAIWVTGWGHTQYGGTNALILQKGEIRVINQTTCENLLPQQITPRMMCVGFLSGGVDSCTGDSGGPLSSVEADGRIFQAGVVSWGDGCAQRNKPGVYTRLSLFRDWIRENTGV

SEQ ID NO: 601 - protein, 241 aa, Artificial Sequence
  MEMBRANE TYPE SERINE PROTEASE 1 (MT-SP1) protease domain I41D/G43A/D96E/F99L/C122S/G151N/Q192T
VVGGTDADEGEWPWQVSLHALGQGHDCAASLISPNWLVSAAHCYIDDRGFRYSDPTQWTAFLGLHDQSQRSAPGVQERRLKRIISHPFFNEFTLDYDIALLELEKPAEYSSMVRPISLPDASHVFPAGKAIWVTGWGHTQYGGTNALILQKGEIRVINQTTCENLLPQQITPRMMCVGFLSGGVDSCTGDSGGPLSSVEADGRIFQAGVVSWGDGCAQRNKPGVYTRLPLFRDWIKENTGV

SEQ ID NO: 602 - protein, 241 aa, Artificial Sequence
  MEMBRANE TYPE SERINE PROTEASE 1 (MT-SP1) protease domain I41D/D96E/F99L/C122S/G151N/Q192T
VVGGTDADEGEWPWQVSLHALGQGHDCGASLISPNWLVSAAHCYIDDRGFRYSDPTQWTAFLGLHDQSQRSAPGVQERRLKRIISHPFFNEFTLDYDIALLELEKPAEYSSMVRPISLPDASHVFPAGKAIWVTGWGHTQYGGTNALILQKGEIRVINQTTCENLLPQQITPRMMCVGFLSGGVDSCTGDSGGPLSSVEADGRIFQAGVVSWGDGCAQRNKPGVYTRLPLFRDWIKENTGV

SEQ ID NO: 603 - protein, 241 aa, Artificial Sequence
  MEMBRANE TYPE SERINE PROTEASE 1 (MT-SP1) protease domain I41D/D96E/C122S/G151N/Q192T
VVGGTDADEGEWPWQVSLHALGQGHDCGASLISPNWLVSAAHCYIDDRGFRYSDPTQWTAFLGLHDQSQRSAPGVQERRLKRIISHPFFNEFTFDYDIALLELEKPAEYSSMVRPISLPDASHVFPAGKAIWVTGWGHTQYGGTNALILQKGEIRVINQTTCENLLPQQITPRMMCVGFLSGGVDSCTGDSGGPLSSVEADGRIFQAGVVSWGDGCAQRNKPGVYTRLPLFRDWIKENTGV

SEQ ID NO: 604 - protein, 241 aa, Artificial Sequence
  MEMBRANE TYPE SERINE PROTEASE 1 (MT-SP1) protease domain I41D/D96E/F99L/C122S/G151N/Q192T/D217E
VVGGTDADEGEWPWQVSLHALGQGHDCGASLISPNWLVSAAHCYIDDRGFRYSDPTQWTAFLGLHDQSQRSAPGVQERRLKRIISHPFFNEFTLDYDIALLELEKPAEYSSMVRPISLPDASHVFPAGKAIWVTGWGHTQYGGTNALILQKGEIRVINQTTCENLLPQQITPRMMCVGFLSGGVDSCTGDSGGPLSSVEADGRIFQAGVVSWGEGCAQRNKPGVYTRLPLFRDWIKENTGV

SEQ ID NO: 605 - protein, 241 aa, Artificial Sequence
  MEMBRANE TYPE SERINE PROTEASE 1 (MT-SP1) protease domain I41D/F99L/M117T/C122S/G151N/Q192T/A204D/D217E
VVGGTDADEGEWPWQVSLHALGQGHDCGASLISPNWLVSAAHCYIDDRGFRYSDPTQWTAFLGLHDQSQRSAPGVQERRLKRIISHPFFNDFTLDYDIALLELEKPAEYSSTVRPISLPDASHVFPAGKAIWVTGWGHTQYGGTNALILQKGEIRVINQTTCENLLPQQITPRMMCVGFLSGGVDSCTGDSGGPLSSVEDDGRIFQAGVVSWGEGCAQRNKPGVYTRLPLFRDWIKENTGV

SEQ ID NO: 606 - protein, 241 aa, Artificial Sequence
  MEMBRANE TYPE SERINE PROTEASE 1 (MT-SP1) protease domain I41D/F99L/C122S/G151N/Q192T/D217E
VVGGTDADEGEWPWQVSLHALGQGHDCGASLISPNWLVSAAHCYIDDRGFRYSDPTQWTAFLGLHDQSQRSAPGVQERRLKRIISHPFFNDFTLDYDIALLELEKPAEYSSMVRPISLPDASHVFPAGKAIWVTGWGHTQYGGTNALILQKGEIRVINQTTCENLLPQQITPRMMCVGFLSGGVDSCTGDSGGPLSSVEADGRIFQAGVVSWGEGCAQRNKPGVYTRLPLFRDWIKENTGV

SEQ ID NO: 607 - protein, 241 aa, Artificial Sequence
  MEMBRANE TYPE SERINE PROTEASE 1 (MT-SP1) protease domain I41D/F99L/C122S/I136M/G151N/Q192T/D217L/K224R
VVGGTDADEGEWPWQVSLHALGQGHDCGASLISPNWLVSAAHCYIDDRGFRYSDPTQWTAFLGLHDQSQRSAPGVQERRLKRIISHPFFNDFTLDYDIALLELEKPAEYSSMVRPISLPDASHVFPAGKAMWVTGWGHTQYGGTNALILQKGEIRVINQTTCENLLPQQITPRMMCVGFLSGGVDSCTGDSGGPLSSVEADGRIFQAGVVSWGLGCAQRNRPGVYTRLPLFRDWIKENTGV

SEQ ID NO: 608 - protein, 241 aa, Artificial Sequence
  MEMBRANE TYPE SERINE PROTEASE 1 (MT-SP1) protease domain I41D/F60eI/D96E/F99L/C122S/G151N/Q192T
VVGGTDADEGEWPWQVSLHALGQGHDCGASLISPNWLVSAAHCYIDDRGIRYSDPTQWTAFLGLHDQSQRSAPGVQERRLKRIISHPFFNEFTLDYDIALLELEKPAEYSSMVRPISLPDASHVFPAGKAIWVTGWGHTQYGGTNALILQKGEIRVINQTTCENLLPQQITPRMMCVGFLSGGVDSCTGDSGGPLSSVEADGRIFQAGVVSWGDGCAQRNKPGVYTRLPLFRDWIKENTGV

SEQ ID NO: 609 - protein, 241 aa, Artificial Sequence
  MEMBRANE TYPE SERINE PROTEASE 1 (MT-SP1) protease domain I41D/C122S/G151N/Q192T/D217E
VVGGTDADEGEWPWQVSLHALGQGHDCGASLISPNWLVSAAHCYIDDRGFRYSDPTQWTAFLGLHDQSQRSAPGVQERRLKRIISHPFFNDFTFDYDIALLELEKPAEYSSMVRPISLPDASHVFPAGKAIWVTGWGHTQYGGTNALILQKGEIRVINQTTCENLLPQQITPRMMCVGFLSGGVDSCTGDSGGPLSSVEADGRIFQAGVVSWGEGCAQRNKPGVYTRLPLFRDWIKENTGV

SEQ ID NO: 610 - protein, 241 aa, Artificial Sequence
  MEMBRANE TYPE SERINE PROTEASE 1 (MT-SP1) protease domain D96E/C122S/G151N/Q192T
VVGGTDADEGEWPWQVSLHALGQGHICGASLISPNWLVSAAHCYIDDRGFRYSDPTQWTAFLGLHDQSQRSAPGVQERRLKRIISHPFFNEFTFDYDIALLELEKPAEYSSMVRPISLPDASHVFPAGKAIWVTGWGHTQYGGTNALILQKGEIRVINQTTCENLLPQQITPRMMCVGFLSGGVDSCTGDSGGPLSSVEADGRIFQAGVVSWGDGCAQRNKPGVYTRLPLFRDWIKENTGV

SEQ ID NO: 611 - protein, 241 aa, Artificial Sequence
  MEMBRANE TYPE SERINE PROTEASE 1 (MT-SP1) protease domain Y59F/C122S/G151N/Q192T
VVGGTDADEGEWPWQVSLHALGQGHICGASLISPNWLVSAAHCFIDDRGFRYSDPTQWTAFLGLHDQSQRSAPGVQERRLKRIISHPFFNDFTFDYDIALLELEKPAEYSSMVRPISLPDASHVFPAGKAIWVTGWGHTQYGGTNALILQKGEIRVINQTTCENLLPQQITPRMMCVGFLSGGVDSCTGDSGGPLSSVEADGRIFQAGVVSWGDGCAQRNKPGVYTRLPLFRDWIKENTGV

SEQ ID NO: 612 - protein, 241 aa, Artificial Sequence
  MEMBRANE TYPE SERINE PROTEASE 1 (MT-SP1) protease domain Q38H/I41S/D60bT/F60eS/Y60gW/D96K/F97G/F99L/C122S/G 151H/Q175L/Q192D
VVGGTDADEGEWPWQVSLHALGHGHSCGASLISPNWLVSAAHCYIDTRGSRWSDPTQWTAFLGLHDQSQRSAPGVQERRLKRIISHPFFNKGTLDYDIALLELEKPAEYSSMVRPISLPDASHVFPAGKAIWVTGWGHTQYGGTHALILQKGEIRVINQTTCENLLPQLITPRMMCVGFLSGGVDSCDGDSGGPLSSVEADGRIFQAGVVSWGDGCAQRNKPGVYTRLPLFRDWIKENTGV

SEQ ID NO: 613 - protein, 242 aa, Artificial Sequence
  MEMBRANE TYPE SERINE PROTEASE 1 (MT-SP1) protease domain I41S/ins97aV/C122S/Q192D
VVGGTDADEGEWPWQVSLHALGQGHSCGASLISPNWLVSAAHCYIDDRGFRYSDPTQWTAFLGLHDQSQRSAPGVQERRLKRIISHPFFNDFVTFDYDIALLELEKPAEYSSMVRPISLPDASHVFPAGKAIWVTGWGHTQYGGTGALILQKGEIRVINQTTCENLLPQQITPRMMCVGFLSGGVDSCDGDSGGPLSSVEADGRIFQAGVVSWGDGCAQRNKPGVYTRLPLFRDWIKENTGV

SEQ ID NO: 614 - protein, 241 aa, Artificial Sequence
  MEMBRANE TYPE SERINE PROTEASE 1 (MT-SP1) protease domain I41S/F97L/F99L/C122S/Q192S
VVGGTDADEGEWPWQVSLHALGQGHSCGASLISPNWLVSAAHCYIDDRGFRYSDPTQWTAFLGLHDQSQRSAPGVQERRLKRIISHPFFNDLTLDYDIALLELEKPAEYSSMVRPISLPDASHVFPAGKAIWVTGWGHTQYGGTGALILQKGEIRVINQTTCENLLPQQITPRMMCVGFLSGGVDSCSGDSGGPLSSVEADGRIFQAGVVSWGDGCAQRNKPGVYTRLPLFRDWIKENTGV

SEQ ID NO: 615 - protein, 242 aa, Artificial Sequence
  MEMBRANE TYPE SERINE PROTEASE 1 (MT-SP1) protease domain I41T/F97R/ins97aV/T98L/C122S/Q192S
VVGGTDADEGEWPWQVSLHALGQGHTCGASLISPNWLVSAAHCYIDDRGFRYSDPTQWTAFLGLHDQSQRSAPGVQERRLKRIISHPFFNDRVLFDYDIALLELEKPAEYSSMVRPISLPDASHVFPAGKAIWVTGWGHTQYGGTGALILQKGEIRVINQTTCENLLPQQITPRMMCVGFLSGGVDSCSGDSGGPLSSVEADGRIFQAGVVSWGDGCAQRNKPGVYTRLPLFRDWIKENTGV

SEQ ID NO: 616 - protein, 241 aa, Artificial Sequence
  MEMBRANE TYPE SERINE PROTEASE 1 (MT-SP1) protease domain I41S/F97V/T98N/F99L/C122S/Q192S
VVGGTDADEGEWPWQVSLHALGQGHSCGASLISPNWLVSAAHCYIDDRGFRYSDPTQWTAFLGLHDQSQRSAPGVQERRLKRIISHPFFNDVNLDYDIALLELEKPAEYSSMVRPISLPDASHVFPAGKAIWVTGWGHTQYGGTGALILQKGEIRVINQTTCENLLPQQITPRMMCVGFLSGGVDSCSGDSGGPLSSVEADGRIFQAGVVSWGDGCAQRNKPGVYTRLPLFRDWIKENTGV

SEQ ID NO: 617 - protein, 242 aa, Artificial Sequence
  MEMBRANE TYPE SERINE PROTEASE 1 (MT-SP1) protease domain I41S/F97G/ins97aA/T98L/C122S/Q192A
VVGGTDADEGEWPWQVSLHALGQGHSCGASLISPNWLVSAAHCYIDDRGFRYSDPTQWTAFLGLHDQSQRSAPGVQERRLKRIISHPFFNDGALFDYDIALLELEKPAEYSSMVRPISLPDASHVFPAGKAIWVTGWGHTQYGGTGALILQKGEIRVINQTTCENLLPQQITPRMMCVGFLSGGVDSCAGDSGGPLSSVEADGRIFQAGVVSWGDGCAQRNKPGVYTRLPLFRDWIKENTGV

SEQ ID NO: 618 - protein, 241 aa, Artificial Sequence
  MEMBRANE TYPE SERINE PROTEASE 1 (MT-SP1) protease domain I41S/F97D/F99L/C122S/Q192V
VVGGTDADEGEWPWQVSLHALGQGHSCGASLISPNWLVSAAHCYIDDRGFRYSDPTQWTAFLGLHDQSQRSAPGVQERRLKRIISHPFFNDDTLDYDIALLELEKPAEYSSMVRPISLPDASHVFPAGKAIWVTGWGHTQYGGTGALILQKGEIRVINQTTCENLLPQQITPRMMCVGFLSGGVDSCVGDSGGPLSSVEADGRIFQAGVVSWGDGCAQRNKPGVYTRLPLFRDWIKENTGV

SEQ ID NO: 619 - protein, 241 aa, Artificial Sequence
  MEMBRANE TYPE SERINE PROTEASE 1 (MT-SP1) protease domain I41E/F97L/F99L/C122S/Q192A
VVGGTDADEGEWPWQVSLHALGQGHECGASLISPNWLVSAAHCYIDDRGFRYSDPTQWTAFLGLHDQSQRSAPGVQERRLKRIISHPFFNDLTLDYDIALLELEKPAEYSSMVRPISLPDASHVFPAGKAIWVTGWGHTQYGGTGALILQKGEIRVINQTTCENLLPQQITPRMMCVGFLSGGVDSCAGDSGGPLSSVEADGRIFQAGVVSWGDGCAQRNKPGVYTRLPLFRDWIKENTGV

SEQ ID NO: 620 - protein, 242 aa, Artificial Sequence
  MEMBRANE TYPE SERINE PROTEASE 1 (MT-SP1) protease domain I41S/F97A/ins97aV/T98L/C122S/Q192A
VVGGTDADEGEWPWQVSLHALGQGHSCGASLISPNWLVSAAHCYIDDRGFRYSDPTQWTAFLGLHDQSQRSAPGVQERRLKRIISHPFFNDAVLFDYDIALLELEKPAEYSSMVRPISLPDASHVFPAGKAIWVTGWGHTQYGGTGALILQKGEIRVINQTTCENLLPQQITPRMMCVGFLSGGVDSCAGDSGGPLSSVEADGRIFQAGVVSWGDGCAQRNKPGVYTRLPLFRDWIKENTGV

SEQ ID NO: 621 - protein, 240 aa, Artificial Sequence
  MEMBRANE TYPE SERINE PROTEASE 1 (MT-SP1) protease domain I41S/F97del/T98S/F99L/C122S/Q192S
VVGGTDADEGEWPWQVSLHALGQGHSCGASLISPNWLVSAAHCYIDDRGFRYSDPTQWTAFLGLHDQSQRSAPGVQERRLKRIISHPFFNDSLDYDIALLELEKPAEYSSMVRPISLPDASHVFPAGKAIWVTGWGHTQYGGTGALILQKGEIRVINQTTCENLLPQQITPRMMCVGFLSGGVDSCSGDSGGPLSSVEADGRIFQAGVVSWGDGCAQRNKPGVYTRLPLFRDWIKENTGV

SEQ ID NO: 622 - protein, 241 aa, Artificial Sequence
  MEMBRANE TYPE SERINE PROTEASE 1 (MT-SP1) protease domain I41A/Y60gW/D96F/F97G/F99M/C122S/Q175W/Q192A
VVGGTDADEGEWPWQVSLHALGQGHACGASLISPNWLVSAAHCYIDDRGFRWSDPTQWTAFLGLHDQSQRSAPGVQERRLKRIISHPFFNFGTMDYDIALLELEKPAEYSSMVRPISLPDASHVFPAGKAIWVTGWGHTQYGGTGALILQKGEIRVINQTTCENLLPQWITPRMMCVGFLSGGVDSCAGDSGGPLSSVEADGRIFQAGVVSWGDGCAQRNKPGVYTRLPLFRDWIKENTGV

SEQ ID NO: 623 - protein, 241 aa, Artificial Sequence
  MEMBRANE TYPE SERINE PROTEASE 1 (MT-SP1) protease domain I41G/Y60gW/F99L/C122S/Q175R/Q192S
VVGGTDADEGEWPWQVSLHALGQGHGCGASLISPNWLVSAAHCYIDDRGFRWSDPTQWTAFLGLHDQSQRSAPGVQERRLKRIISHPFFNDFTLDYDIALLELEKPAEYSSMVRPISLPDASHVFPAGKAIWVTGWGHTQYGGTGALILQKGEIRVINQTTCENLLPQRITPRMMCVGFLSGGVDSCSGDSGGPLSSVEADGRIFQAGVVSWGDGCAQRNKPGVYTRLPLFRDWIKENTGV

SEQ ID NO: 624 - protein, 242 aa, Artificial Sequence
  MEMBRANE TYPE SERINE PROTEASE 1 (MT-SP1) protease domain I41A/Y60gW/ins97aE/F99L/C122S/Q175M/Q192T
VVGGTDADEGEWPWQVSLHALGQGHACGASLISPNWLVSAAHCYIDDRGFRWSDPTQWTAFLGLHDQSQRSAPGVQERRLKRIISHPFFNDFETLDYDIALLELEKPAEYSSMVRPISLPDASHVFPAGKAIWVTGWGHTQYGGTGALILQKGEIRVINQTTCENLLPQMITPRMMCVGFLSGGVDSCTGDSGGPLSSVEADGRIFQAGVVSWGDGCAQRNKPGVYTRLPLFRDWIKENTGV

SEQ ID NO: 625 - protein, 242 aa, Artificial Sequence
  MEMBRANE TYPE SERINE PROTEASE 1 (MT-SP1) protease domain I41T/ins97aA/F99Y/C122S/Q175L/Q192A
VVGGTDADEGEWPWQVSLHALGQGHTCGASLISPNWLVSAAHCYIDDRGFRYSDPTQWTAFLGLHDQSQRSAPGVQERRLKRIISHPFFNDFATYDYDIALLELEKPAEYSSMVRPISLPDASHVFPAGKAIWVTGWGHTQYGGTGALILQKGEIRVINQTTCENLLPQLITPRMMCVGFLSGGVDSCAGDSGGPLSSVEADGRIFQAGVVSWGDGCAQRNKPGVYTRLPLFRDWIKENTGV

SEQ ID NO: 626 - protein, 242 aa, Artificial Sequence
  MEMBRANE TYPE SERINE PROTEASE 1 (MT-SP1) protease domain I41A/ins97aY/F99L/C122S/Q175R/Q192H
VVGGTDADEGEWPWQVSLHALGQGHACGASLISPNWLVSAAHCYIDDRGFRYSDPTQWTAFLGLHDQSQRSAPGVQERRLKRIISHPFFNDFYTLDYDIALLELEKPAEYSSMVRPISLPDASHVFPAGKAIWVTGWGHTQYGGTGALILQKGEIRVINQTTCENLLPQRITPRMMCVGFLSGGVDSCHGDSGGPLSSVEADGRIFQAGVVSWGDGCAQRNKPGVYTRLPLFRDWIKENTGV

SEQ ID NO: 627 - protein, 242 aa, Artificial Sequence
  MEMBRANE TYPE SERINE PROTEASE 1 (MT-SP1) protease domain I41S/ins97aT/F99L/C122S/Q175R/Q192H
VVGGTDADEGEWPWQVSLHALGQGHSCGASLISPNWLVSAAHCYIDDRGFRYSDPTQWTAFLGLHDQSQRSAPGVQERRLKRIISHPFFNDFTTLDYDIALLELEKPAEYSSMVRPISLPDASHVFPAGKAIWVTGWGHTQYGGTGALILQKGEIRVINQTTCENLLPQRITPRMMCVGFLSGGVDSCHGDSGGPLSSVEADGRIFQAGVVSWGDGCAQRNKPGVYTRLPLFRDWIKENTGV

SEQ ID NO: 628 - protein, 242 aa, Artificial Sequence
  MEMBRANE TYPE SERINE PROTEASE 1 (MT-SP1) protease domain I41S/Y60gW/ins97aN/F99L/C122S/Q175R/Q192T
VVGGTDADEGEWPWQVSLHALGQGHSCGASLISPNWLVSAAHCYIDDRGFRWSDPTQWTAFLGLHDQSQRSAPGVQERRLKRIISHPFFNDFNTLDYDIALLELEKPAEYSSMVRPISLPDASHVFPAGKAIWVTGWGHTQYGGTGALILQKGEIRVINQTTCENLLPQRITPRMMCVGFLSGGVDSCTGDSGGPLSSVEADGRIFQAGVVSWGDGCAQRNKPGVYTRLPLFRDWIKENTGV

SEQ ID NO: 629 - protein, 242 aa, Artificial Sequence
  MEMBRANE TYPE SERINE PROTEASE 1 (MT-SP1) protease domain Q38H/I41S/D96S/ins97aK/C122S/G151N/Q192A
VVGGTDADEGEWPWQVSLHALGHGHSCGASLISPNWLVSAAHCYIDDRGFRYSDPTQWTAFLGLHDQSQRSAPGVQERRLKRIISHPFFNSFKTFDYDIALLELEKPAEYSSMVRPISLPDASHVFPAGKAIWVTGWGHTQYGGTNALILQKGEIRVINQTTCENLLPQQITPRMMCVGFLSGGVDSCAGDSGGPLSSVEADGRIFQAGVVSWGDGCAQRNKPGVYTRLPLFRDWIKENTGV

SEQ ID NO: 630 - protein, 242 aa, Artificial Sequence
  MEMBRANE TYPE SERINE PROTEASE 1 (MT-SP1) protease domain Q38H/I41A/D96A/ins97aA/C122S/G151D/Q192T
VVGGTDADEGEWPWQVSLHALGHGHACGASLISPNWLVSAAHCYIDDRGFRYSDPTQWTAFLGLHDQSQRSAPGVQERRLKRIISHPFFNAFATFDYDIALLELEKPAEYSSMVRPISLPDASHVFPAGKAIWVTGWGHTQYGGTDALILQKGEIRVINQTTCENLLPQQITPRMMCVGFLSGGVDSCTGDSGGPLSSVEADGRIFQAGVVSWGDGCAQRNKPGVYTRLPLFRDWIKENTGV

SEQ ID NO: 631 - protein, 242 aa, Artificial Sequence
  MEMBRANE TYPE SERINE PROTEASE 1 (MT-SP1) protease domain Q38H/I41S/D96Q/ins97aT/C122S/G151N/Q192A
VVGGTDADEGEWPWQVSLHALGHGHSCGASLISPNWLVSAAHCYIDDRGFRYSDPTQWTAFLGLHDQSQRSAPGVQERRLKRIISHPFFNQFTTFDYDIALLELEKPAEYSSMVRPISLPDASHVFPAGKAIWVTGWGHTQYGGTNALILQKGEIRVINQTTCENLLPQQITPRMMCVGFLSGGVDSCAGDSGGPLSSVEADGRIFQAGVVSWGDGCAQRNKPGVYTRLPLFRDWIKENTGV

SEQ ID NO: 632 - protein, 242 aa, Artificial Sequence
  MEMBRANE TYPE SERINE PROTEASE 1 (MT-SP1) protease domain Q38H/I41T/D96M/ins97aA/C122S/G151D
VVGGTDADEGEWPWQVSLHALGHGHTCGASLISPNWLVSAAHCYIDDRGFRYSDPTQWTAFLGLHDQSQRSAPGVQERRLKRIISHPFFNMFATFDYDIALLELEKPAEYSSMVRPISLPDASHVFPAGKAIWVTGWGHTQYGGTDALILQKGEIRVINQTTCENLLPQQITPRMMCVGFLSGGVDSCQGDSGGPLSSVEADGRIFQAGVVSWGDGCAQRNKPGVYTRLPLFRDWIKENTGV

SEQ ID NO: 633 - protein, 242 aa, Artificial Sequence
  MEMBRANE TYPE SERINE PROTEASE 1 (MT-SP1) protease domain Q38Y/I41A/D96I/ins97aQ/C122S
VVGGTDADEGEWPWQVSLHALGYGHACGASLISPNWLVSAAHCYIDDRGFRYSDPTQWTAFLGLHDQSQRSAPGVQERRLKRIISHPFFNIFQTFDYDIALLELEKPAEYSSMVRPISLPDASHVFPAGKAIWVTGWGHTQYGGTGALILQKGEIRVINQTTCENLLPQQITPRMMCVGFLSGGVDSCQGDSGGPLSSVEADGRIFQAGVVSWGDGCAQRNKPGVYTRLPLFRDWIKENTGV

SEQ ID NO: 634 - protein, 242 aa, Artificial Sequence
  MEMBRANE TYPE SERINE PROTEASE 1 (MT-SP1) protease domain Q38H/I41S/D96K/ins97aT/C122S/G151K/Q192A
VVGGTDADEGEWPWQVSLHALGHGHSCGASLISPNWLVSAAHCYIDDRGFRYSDPTQWTAFLGLHDQSQRSAPGVQERRLKRIISHPFFNKFTTFDYDIALLELEKPAEYSSMVRPISLPDASHVFPAGKAIWVTGWGHTQYGGTKALILQKGEIRVINQTTCENLLPQQITPRMMCVGFLSGGVDSCAGDSGGPLSSVEADGRIFQAGVVSWGDGCAQRNKPGVYTRLPLFRDWIKENTGV

SEQ ID NO: 635 - protein, 242 aa, Artificial Sequence
  MEMBRANE TYPE SERINE PROTEASE 1 (MT-SP1) protease domain Q38W/I41S/D96R/ins97aA/C122S/G151N/Q192A
VVGGTDADEGEWPWQVSLHALGWGHSCGASLISPNWLVSAAHCYIDDRGFRYSDPTQWTAFLGLHDQSQRSAPGVQERRLKRIISHPFFNRFATFDYDIALLELEKPAEYSSMVRPISLPDASHVFPAGKAIWVTGWGHTQYGGTNALILQKGEIRVINQTTCENLLPQQITPRMMCVGFLSGGVDSCAGDSGGPLSSVEADGRIFQAGVVSWGDGCAQRNKPGVYTRLPLFRDWIKENTGV

SEQ ID NO: 636 - protein, 242 aa, Artificial Sequence
  MEMBRANE TYPE SERINE PROTEASE 1 (MT-SP1) protease domain Q38H/I41A/D96R/ins97aQ/C122S
VVGGTDADEGEWPWQVSLHALGHGHACGASLISPNWLVSAAHCYIDDRGFRYSDPTQWTAFLGLHDQSQRSAPGVQERRLKRIISHPFFNRFQTFDYDIALLELEKPAEYSSMVRPISLPDASHVFPAGKAIWVTGWGHTQYGGTGALILQKGEIRVINQTTCENLLPQQITPRMMCVGFLSGGVDSCQGDSGGPLSSVEADGRIFQAGVVSWGDGCAQRNKPGVYTRLPLFRDWIKENTGV

SEQ ID NO: 637 - protein, 242 aa, Artificial Sequence
  MEMBRANE TYPE SERINE PROTEASE 1 (MT-SP1) protease domain Q38F/I41V/D96Q/ins97aT/C122S/G151D
VVGGTDADEGEWPWQVSLHALGFGHVCGASLISPNWLVSAAHCYIDDRGFRYSDPTQWTAFLGLHDQSQRSAPGVQERRLKRIISHPFFNQFTTFDYDIALLELEKPAEYSSMVRPISLPDASHVFPAGKAIWVTGWGHTQYGGTDALILQKGEIRVINQTTCENLLPQQITPRMMCVGFLSGGVDSCQGDSGGPLSSVEADGRIFQAGVVSWGDGCAQRNKPGVYTRLPLFRDWIKENTGV

SEQ ID NO: 638 - protein, 242 aa, Artificial Sequence
  MEMBRANE TYPE SERINE PROTEASE 1 (MT-SP1) protease domain L33M/Q38F/I41S/D96A/ins97aW/C122S/G151N/Q192S
VVGGTDADEGEWPWQVSMHALGFGHSCGASLISPNWLVSAAHCYIDDRGFRYSDPTQWTAFLGLHDQSQRSAPGVQERRLKRIISHPFFNAFWTFDYDIALLELEKPAEYSSMVRPISLPDASHVFPAGKAIWVTGWGHTQYGGTNALILQKGEIRVINQTTCENLLPQQITPRMMCVGFLSGGVDSCSGDSGGPLSSVEADGRIFQAGVVSWGDGCAQRNKPGVYTRLPLFRDWIKENTGV

SEQ ID NO: 639 - protein, 242 aa, Artificial Sequence
  MEMBRANE TYPE SERINE PROTEASE 1 (MT-SP1) protease domain Q38H/I41S/D96V/ins97aA/C122S/G151N/Q192A
VVGGTDADEGEWPWQVSLHALGHGHSCGASLISPNWLVSAAHCYIDDRGFRYSDPTQWTAFLGLHDQSQRSAPGVQERRLKRIISHPFFNVFATFDYDIALLELEKPAEYSSMVRPISLPDASHVFPAGKAIWVTGWGHTQYGGTNALILQKGEIRVINQTTCENLLPQQITPRMMCVGFLSGGVDSCAGDSGGPLSSVEADGRIFQAGVVSWGDGCAQRNKPGVYTRLPLFRDWIKENTGV

SEQ ID NO: 640 - protein, 242 aa, Artificial Sequence
  MEMBRANE TYPE SERINE PROTEASE 1 (MT-SP1) protease domain Q38H/I41T/D96K/ins97aL/C122S/G151N/Q192A
VVGGTDADEGEWPWQVSLHALGHGHTCGASLISPNWLVSAAHCYIDDRGFRYSDPTQWTAFLGLHDQSQRSAPGVQERRLKRIISHPFFNKFLTFDYDIALLELEKPAEYSSMVRPISLPDASHVFPAGKAIWVTGWGHTQYGGTNALILQKGEIRVINQTTCENLLPQQITPRMMCVGFLSGGVDSCAGDSGGPLSSVEADGRIFQAGVVSWGDGCAQRNKPGVYTRLPLFRDWIKENTGV

SEQ ID NO: 641 - protein, 242 aa, Artificial Sequence
  MEMBRANE TYPE SERINE PROTEASE 1 (MT-SP1) protease domain Q38H/I41S/D96Q/ins97aA/C122S/Q192T
VVGGTDADEGEWPWQVSLHALGHGHSCGASLISPNWLVSAAHCYIDDRGFRYSDPTQWTAFLGLHDQSQRSAPGVQERRLKRIISHPFFNQFATFDYDIALLELEKPAEYSSMVRPISLPDASHVFPAGKAIWVTGWGHTQYGGTGALILQKGEIRVINQTTCENLLPQQITPRMMCVGFLSGGVDSCTGDSGGPLSSVEADGRIFQAGVVSWGDGCAQRNKPGVYTRLPLFRDWIKENTGV

SEQ ID NO: 642 - protein, 242 aa, Artificial Sequence
  MEMBRANE TYPE SERINE PROTEASE 1 (MT-SP1) protease domain Q38W/I41V/D96R/ins97aA/C122S/G151N
VVGGTDADEGEWPWQVSLHALGWGHVCGASLISPNWLVSAAHCYIDDRGFRYSDPTQWTAFLGLHDQSQRSAPGVQERRLKRIISHPFFNRFATFDYDIALLELEKPAEYSSMVRPISLPDASHVFPAGKAIWVTGWGHTQYGGTNALILQKGEIRVINQTTCENLLPQQITPRMMCVGFLSGGVDSCQGDSGGPLSSVEADGRIFQAGVVSWGDGCAQRNKPGVYTRLPLFRDWIKENTGV

SEQ ID NO: 643 - protein, 242 aa, Artificial Sequence
  MEMBRANE TYPE SERINE PROTEASE 1 (MT-SP1) protease domain Q38Y/I41T/D96M/ins97aS/C122S/G151N
VVGGTDADEGEWPWQVSLHALGYGHTCGASLISPNWLVSAAHCYIDDRGFRYSDPTQWTAFLGLHDQSQRSAPGVQERRLKRIISHPFFNMFSTFDYDIALLELEKPAEYSSMVRPISLPDASHVFPAGKAIWVTGWGHTQYGGTNALILQKGEIRVINQTTCENLLPQQITPRMMCVGFLSGGVDSCQGDSGGPLSSVEADGRIFQAGVVSWGDGCAQRNKPGVYTRLPLFRDWIKENTGV

SEQ ID NO: 644 - protein, 242 aa, Artificial Sequence
  MEMBRANE TYPE SERINE PROTEASE 1 (MT-SP1) protease domain Q38H/I41S/D96K/ins97aS/C122S/G151P/Q192S
VVGGTDADEGEWPWQVSLHALGHGHSCGASLISPNWLVSAAHCYIDDRGFRYSDPTQWTAFLGLHDQSQRSAPGVQERRLKRIISHPFFNKFSTFDYDIALLELEKPAEYSSMVRPISLPDASHVFPAGKAIWVTGWGHTQYGGTPALILQKGEIRVINQTTCENLLPQQITPRMMCVGFLSGGVDSCSGDSGGPLSSVEADGRIFQAGVVSWGDGCAQRNKPGVYTRLPLFRDWIKENTGV

SEQ ID NO: 645 - protein, 242 aa, Artificial Sequence
  MEMBRANE TYPE SERINE PROTEASE 1 (MT-SP1) protease domain Q38H/I41S/D96G/ins97aG/C122S/G151N/Q192A
VVGGTDADEGEWPWQVSLHALGHGHSCGASLISPNWLVSAAHCYIDDRGFRYSDPTQWTAFLGLHDQSQRSAPGVQERRLKRIISHPFFNGFGTFDYDIALLELEKPAEYSSMVRPISLPDASHVFPAGKAIWVTGWGHTQYGGTNALILQKGEIRVINQTTCENLLPQQITPRMMCVGFLSGGVDSCAGDSGGPLSSVEADGRIFQAGVVSWGDGCAQRNKPGVYTRLPLFRDWIKENTGV

SEQ ID NO: 646 - protein, 242 aa, Artificial Sequence
  MEMBRANE TYPE SERINE PROTEASE 1 (MT-SP1) protease domain Q38H/I41S/D96K/ins97aD/C122S/G151N/Q192S
VVGGTDADEGEWPWQVSLHALGHGHSCGASLISPNWLVSAAHCYIDDRGFRYSDPTQWTAFLGLHDQSQRSAPGVQERRLKRIISHPFFNKFDTFDYDIALLELEKPAEYSSMVRPISLPDASHVFPAGKAIWVTGWGHTQYGGTNALILQKGEIRVINQTTCENLLPQQITPRMMCVGFLSGGVDSCSGDSGGPLSSVEADGRIFQAGVVSWGDGCAQRNKPGVYTRLPLFRDWIKENTGV

SEQ ID NO: 647 - protein, 242 aa, Artificial Sequence
  MEMBRANE TYPE SERINE PROTEASE 1 (MT-SP1) protease domain I41S/D96E/ins97aG/C122S/G151Q/Q192A
VVGGTDADEGEWPWQVSLHALGQGHSCGASLISPNWLVSAAHCYIDDRGFRYSDPTQWTAFLGLHDQSQRSAPGVQERRLKRIISHPFFNEFGTFDYDIALLELEKPAEYSSMVRPISLPDASHVFPAGKAIWVTGWGHTQYGGTQALILQKGEIRVINQTTCENLLPQQITPRMMCVGFLSGGVDSCAGDSGGPLSSVEADGRIFQAGVVSWGDGCAQRNKPGVYTRLPLFRDWIKENTGV

SEQ ID NO: 648 - protein, 242 aa, Artificial Sequence
  MEMBRANE TYPE SERINE PROTEASE 1 (MT-SP1) protease domain I41S/Y59F/ins97aV/C122S/G187D/Q192V/D217V
VVGGTDADEGEWPWQVSLHALGQGHSCGASLISPNWLVSAAHCFIDDRGFRYSDPTQWTAFLGLHDQSQRSAPGVQERRLKRIISHPFFNDFVTFDYDIALLELEKPAEYSSMVRPISLPDASHVFPAGKAIWVTGWGHTQYGGTGALILQKGEIRVINQTTCENLLPQQITPRMMCVGFLSGDVDSCVGDSGGPLSSVEADGRIFQAGVVSWGVGCAQRNKPGVYTRLPLFRDWIKENTGV

SEQ ID NO: 649 - protein, 241 aa, Artificial Sequence
  MEMBRANE TYPE SERINE PROTEASE 1 (MT-SP1) protease domain A35V/I41S/Y59F/C122S/Q192D/D217V
VVGGTDADEGEWPWQVSLHVLGQGHSCGASLISPNWLVSAAHCFIDDRGFRYSDPTQWTAFLGLHDQSQRSAPGVQERRLKRIISHPFFNDFTFDYDIALLELEKPAEYSSMVRPISLPDASHVFPAGKAIWVTGWGHTQYGGTGALILQKGEIRVINQTTCENLLPQQITPRMMCVGFLSGGVDSCDGDSGGPLSSVEADGRIFQAGVVSWGVGCAQRNKPGVYTRLPLFRDWIKENTGV

SEQ ID NO: 650 - protein, 242 aa, Artificial Sequence
  MEMBRANE TYPE SERINE PROTEASE 1 (MT-SP1) protease domain I41S/F93L/ins97aV/C122S/Q192V/D217V
VVGGTDADEGEWPWQVSLHALGQGHSCGASLISPNWLVSAAHCYIDDRGFRYSDPTQWTAFLGLHDQSQRSAPGVQERRLKRIISHPLFNDFVTFDYDIALLELEKPAEYSSMVRPISLPDASHVFPAGKAIWVTGWGHTQYGGTGALILQKGEIRVINQTTCENLLPQQITPRMMCVGFLSGGVDSCVGDSGGPLSSVEADGRIFQAGVVSWGVGCAQRNKPGVYTRLPLFRDWIKENTGV

SEQ ID NO: 651 - protein, 242 aa, Artificial Sequence
  MEMBRANE TYPE SERINE PROTEASE 1 (MT-SP1) protease domain I41S/S90P/ins97aV/C122S/Y146E/Q192N/D217V
VVGGTDADEGEWPWQVSLHALGQGHSCGASLISPNWLVSAAHCYIDDRGFRYSDPTQWTAFLGLHDQSQRSAPGVQERRLKRIIPHPFFNDFVTFDYDIALLELEKPAEYSSMVRPISLPDASHVFPAGKAIWVTGWGHTQEGGTGALILQKGEIRVINQTTCENLLPQQITPRMMCVGFLSGGVDSCNGDSGGPLSSVEADGRIFQAGVVSWGVGCAQRNKPGVYTRLPLFRDWIKENTGV

SEQ ID NO: 652 - protein, 242 aa, Artificial Sequence
  MEMBRANE TYPE SERINE PROTEASE 1 (MT-SP1) protease domain I41S/S90T/ins97aV/C122S/Q192N/D217V
VVGGTDADEGEWPWQVSLHALGQGHSCGASLISPNWLVSAAHCYIDDRGFRYSDPTQWTAFLGLHDQSQRSAPGVQERRLKRIITHPFFNDFVTFDYDIALLELEKPAEYSSMVRPISLPDASHVFPAGKAIWVTGWGHTQYGGTGALILQKGEIRVINQTTCENLLPQQITPRMMCVGFLSGGVDSCNGDSGGPLSSVEADGRIFQAGVVSWGVGCAQRNKPGVYTRLPLFRDWIKENTGV

SEQ ID NO: 653 - protein, 242 aa, Artificial Sequence
  MEMBRANE TYPE SERINE PROTEASE 1 (MT-SP1) protease domain I41S/S90T/ins97aV/C122S/Q192V/D217V
VVGGTDADEGEWPWQVSLHALGQGHSCGASLISPNWLVSAAHCYIDDRGFRYSDPTQWTAFLGLHDQSQRSAPGVQERRLKRIITHPFFNDFVTFDYDIALLELEKPAEYSSMVRPISLPDASHVFPAGKAIWVTGWGHTQYGGTGALILQKGEIRVINQTTCENLLPQQITPRMMCVGFLSGGVDSCVGDSGGPLSSVEADGRIFQAGVVSWGVGCAQRNKPGVYTRLPLFRDWIKENTGV

SEQ ID NO: 654 - protein, 242 aa, Artificial Sequence
  MEMBRANE TYPE SERINE PROTEASE 1 (MT-SP1) protease domain I41S/Y59F/ins97aV/C122S/Q192G
VVGGTDADEGEWPWQVSLHALGQGHSCGASLISPNWLVSAAHCFIDDRGFRYSDPTQWTAFLGLHDQSQRSAPGVQERRLKRIISHPFFNDFVTFDYDIALLELEKPAEYSSMVRPISLPDASHVFPAGKAIWVTGWGHTQYGGTGALILQKGEIRVINQTTCENLLPQQITPRMMCVGFLSGGVDSCGGDSGGPLSSVEADGRIFQAGVVSWGDGCAQRNKPGVYTRLPLFRDWIKENTGV

SEQ ID NO: 655 - protein, 242 aa, Artificial Sequence
  MEMBRANE TYPE SERINE PROTEASE 1 (MT-SP1) protease domain I41S/Y59F/F97S/ins97aV/S116Y/C122S/Q192G/D217V
VVGGTDADEGEWPWQVSLHALGQGHSCGASLISPNWLVSAAHCFIDDRGFRYSDPTQWTAFLGLHDQSQRSAPGVQERRLKRIISHPFFNDSVTFDYDIALLELEKPAEYSYMVRPISLPDASHVFPAGKAIWVTGWGHTQYGGTGALILQKGEIRVINQTTCENLLPQQITPRMMCVGFLSGGVDSCGGDSGGPLSSVEADGRIFQAGVVSWGVGCAQRNKPGVYTRLPLFRDWIKENTGV

SEQ ID NO: 656 - protein, 242 aa, Artificial Sequence
  MEMBRANE TYPE SERINE PROTEASE 1 (MT-SP1) protease domain I41S/ins97aV/C122S/Q192G/Q209L
VVGGTDADEGEWPWQVSLHALGQGHSCGASLISPNWLVSAAHCYIDDRGFRYSDPTQWTAFLGLHDQSQRSAPGVQERRLKRIISHPFFNDFVTFDYDIALLELEKPAEYSSMVRPISLPDASHVFPAGKAIWVTGWGHTQYGGTGALILQKGEIRVINQTTCENLLPQQITPRMMCVGFLSGGVDSCGGDSGGPLSSVEADGRIFLAGVVSWGDGCAQRNKPGVYTRLPLFRDWIKENTGV

SEQ ID NO: 657 - protein, 242 aa, Artificial Sequence
  MEMBRANE TYPE SERINE PROTEASE 1 (MT-SP1) protease domain Q38H/I41S/ins97aV/A112V/C122S/Q192A/Q209L
VVGGTDADEGEWPWQVSLHALGHGHSCGASLISPNWLVSAAHCYIDDRGFRYSDPTQWTAFLGLHDQSQRSAPGVQERRLKRIISHPFFNDFVTFDYDIALLELEKPVEYSSMVRPISLPDASHVFPAGKAIWVTGWGHTQYGGTGALILQKGEIRVINQTTCENLLPQQITPRMMCVGFLSGGVDSCAGDSGGPLSSVEADGRIFLAGVVSWGDGCAQRNKPGVYTRLPLFRDWIKENTGV

SEQ ID NO: 658 - protein, 242 aa, Artificial Sequence
  MEMBRANE TYPE SERINE PROTEASE 1 (MT-SP1) protease domain I41S/ins97aV/C122S/Q192V/D217V
VVGGTDADEGEWPWQVSLHALGQGHSCGASLISPNWLVSAAHCYIDDRGFRYSDPTQWTAFLGLHDQSQRSAPGVQERRLKRIISHPFFNDFVTFDYDIALLELEKPAEYSSMVRPISLPDASHVFPAGKAIWVTGWGHTQYGGTGALILQKGEIRVINQTTCENLLPQQITPRMMCVGFLSGGVDSCVGDSGGPLSSVEADGRIFQAGVVSWGVGCAQRNKPGVYTRLPLFRDWIKENTGV

SEQ ID NO: 659 - protein, 242 aa, Artificial Sequence
  MEMBRANE TYPE SERINE PROTEASE 1 (MT-SP1) protease domain I41S/Y59F/ins97aV/C122S/Q192A
VVGGTDADEGEWPWQVSLHALGQGHSCGASLISPNWLVSAAHCFIDDRGFRYSDPTQWTAFLGLHDQSQRSAPGVQERRLKRIISHPFFNDFVTFDYDIALLELEKPAEYSSMVRPISLPDASHVFPAGKAIWVTGWGHTQYGGTGALILQKGEIRVINQTTCENLLPQQITPRMMCVGFLSGGVDSCAGDSGGPLSSVEADGRIFQAGVVSWGDGCAQRNKPGVYTRLPLFRDWIKENTGV

SEQ ID NO: 660 - protein, 242 aa, Artificial Sequence
  MEMBRANE TYPE SERINE PROTEASE 1 (MT-SP1) protease domain I41A/F97G/ins97aM/T98L/C122S
VVGGTDADEGEWPWQVSLHALGQGHACGASLISPNWLVSAAHCYIDDRGFRYSDPTQWTAFLGLHDQSQRSAPGVQERRLKRIISHPFFNDGMLFDYDIALLELEKPAEYSSMVRPISLPDASHVFPAGKAIWVTGWGHTQYGGTGALILQKGEIRVINQTTCENLLPQQITPRMMCVGFLSGGVDSCQGDSGGPLSSVEADGRIFQAGVVSWGDGCAQRNKPGVYTRLPLFRDWIKENTGV

SEQ ID NO: 661 - protein, 241 aa, Artificial Sequence
  MEMBRANE TYPE SERINE PROTEASE 1 (MT-SP1) protease domain I41G/F97E/F99L/C122S/Q192A
VVGGTDADEGEWPWQVSLHALGQGHGCGASLISPNWLVSAAHCYIDDRGFRYSDPTQWTAFLGLHDQSQRSAPGVQERRLKRIISHPFFNDETLDYDIALLELEKPAEYSSMVRPISLPDASHVFPAGKAIWVTGWGHTQYGGTGALILQKGEIRVINQTTCENLLPQQITPRMMCVGFLSGGVDSCAGDSGGPLSSVEADGRIFQAGVVSWGDGCAQRNKPGVYTRLPLFRDWIKENTGV

SEQ ID NO: 662 - protein, 242 aa, Artificial Sequence
  MEMBRANE TYPE SERINE PROTEASE 1 (MT-SP1) protease domain I41S/F97V/ins97aV/T98P/C122S
VVGGTDADEGEWPWQVSLHALGQGHSCGASLISPNWLVSAAHCYIDDRGFRYSDPTQWTAFLGLHDQSQRSAPGVQERRLKRIISHPFFNDVVPFDYDIALLELEKPAEYSSMVRPISLPDASHVFPAGKAIWVTGWGHTQYGGTGALILQKGEIRVINQTTCENLLPQQITPRMMCVGFLSGGVDSCQGDSGGPLSSVEADGRIFQAGVVSWGDGCAQRNKPGVYTRLPLFRDWIKENTGV

SEQ ID NO: 663 - protein, 241 aa, Artificial Sequence
  MEMBRANE TYPE SERINE PROTEASE 1 (MT-SP1) protease domain I41S/T98S/F99L/C122S/Q192A
VVGGTDADEGEWPWQVSLHALGQGHSCGASLISPNWLVSAAHCYIDDRGFRYSDPTQWTAFLGLHDQSQRSAPGVQERRLKRIISHPFFNDFSLDYDIALLELEKPAEYSSMVRPISLPDASHVFPAGKAIWVTGWGHTQYGGTGALILQKGEIRVINQTTCENLLPQQITPRMMCVGFLSGGVDSCAGDSGGPLSSVEADGRIFQAGVVSWGDGCAQRNKPGVYTRLPLFRDWIKENTGV

SEQ ID NO: 664 - protein, 241 aa, Artificial Sequence
  MEMBRANE TYPE SERINE PROTEASE 1 (MT-SP1) protease domain I41S/F97Q/F99L/C122S/Q192S
VVGGTDADEGEWPWQVSLHALGQGHSCGASLISPNWLVSAAHCYIDDRGFRYSDPTQWTAFLGLHDQSQRSAPGVQERRLKRIISHPFFNDQTLDYDIALLELEKPAEYSSMVRPISLPDASHVFPAGKAIWVTGWGHTQYGGTGALILQKGEIRVINQTTCENLLPQQITPRMMCVGFLSGGVDSCSGDSGGPLSSVEADGRIFQAGVVSWGDGCAQRNKPGVYTRLPLFRDWIKENTGV

SEQ ID NO: 665 - protein, 241 aa, Artificial Sequence
  MEMBRANE TYPE SERINE PROTEASE 1 (MT-SP1) protease domain I41G/F97L/F99L/C122S/Q192S
VVGGTDADEGEWPWQVSLHALGQGHGCGASLISPNWLVSAAHCYIDDRGFRYSDPTQWTAFLGLHDQSQRSAPGVQERRLKRIISHPFFNDLTLDYDIALLELEKPAEYSSMVRPISLPDASHVFPAGKAIWVTGWGHTQYGGTGALILQKGEIRVINQTTCENLLPQQITPRMMCVGFLSGGVDSCSGDSGGPLSSVEADGRIFQAGVVSWGDGCAQRNKPGVYTRLPLFRDWIKENTGV

SEQ ID NO: 666 - protein, 242 aa, Artificial Sequence
  MEMBRANE TYPE SERINE PROTEASE 1 (MT-SP1) protease domain I41S/F97G/ins97aA/T98P/C122S/Q192A
VVGGTDADEGEWPWQVSLHALGQGHSCGASLISPNWLVSAAHCYIDDRGFRYSDPTQWTAFLGLHDQSQRSAPGVQERRLKRIISHPFFNDGAPFDYDIALLELEKPAEYSSMVRPISLPDASHVFPAGKAIWVTGWGHTQYGGTGALILQKGEIRVINQTTCENLLPQQITPRMMCVGFLSGGVDSCAGDSGGPLSSVEADGRIFQAGVVSWGDGCAQRNKPGVYTRLPLFRDWIKENTGV

SEQ ID NO: 667 - protein, 242 aa, Artificial Sequence
  MEMBRANE TYPE SERINE PROTEASE 1 (MT-SP1) protease domain I41A/F97G/ins97aV/T98E/C122S
VVGGTDADEGEWPWQVSLHALGQGHACGASLISPNWLVSAAHCYIDDRGFRYSDPTQWTAFLGLHDQSQRSAPGVQERRLKRIISHPFFNDGVEFDYDIALLELEKPAEYSSMVRPISLPDASHVFPAGKAIWVTGWGHTQYGGTGALILQKGEIRVINQTTCENLLPQQITPRMMCVGFLSGGVDSCQGDSGGPLSSVEADGRIFQAGVVSWGDGCAQRNKPGVYTRLPLFRDWIKENTGV

SEQ ID NO: 668 - protein, 242 aa, Artificial Sequence
  MEMBRANE TYPE SERINE PROTEASE 1 (MT-SP1) protease domain I41A/F97S/ins97aA/C122S
VVGGTDADEGEWPWQVSLHALGQGHACGASLISPNWLVSAAHCYIDDRGFRYSDPTQWTAFLGLHDQSQRSAPGVQERRLKRIISHPFFNDSATFDYDIALLELEKPAEYSSMVRPISLPDASHVFPAGKAIWVTGWGHTQYGGTGALILQKGEIRVINQTTCENLLPQQITPRMMCVGFLSGGVDSCQGDSGGPLSSVEADGRIFQAGVVSWGDGCAQRNKPGVYTRLPLFRDWIKENTGV

SEQ ID NO: 669 - protein, 241 aa, Artificial Sequence
  MEMBRANE TYPE SERINE PROTEASE 1 (MT-SP1) protease domain I41A/F97W/T98S/F99L/C122S/Q192A
VVGGTDADEGEWPWQVSLHALGQGHACGASLISPNWLVSAAHCYIDDRGFRYSDPTQWTAFLGLHDQSQRSAPGVQERRLKRIISHPFFNDWSLDYDIALLELEKPAEYSSMVRPISLPDASHVFPAGKAIWVTGWGHTQYGGTGALILQKGEIRVINQTTCENLLPQQITPRMMCVGFLSGGVDSCAGDSGGPLSSVEADGRIFQAGVVSWGDGCAQRNKPGVYTRLPLFRDWIKENTGV

SEQ ID NO: 670 - protein, 241 aa, Artificial Sequence
  MEMBRANE TYPE SERINE PROTEASE 1 (MT-SP1) protease domain I41L/N95D/D96T/F97W/F99L/C122S/Q192A
VVGGTDADEGEWPWQVSLHALGQGHLCGASLISPNWLVSAAHCYIDDRGFRYSDPTQWTAFLGLHDQSQRSAPGVQERRLKRIISHPFFDTWTLDYDIALLELEKPAEYSSMVRPISLPDASHVFPAGKAIWVTGWGHTQYGGTGALILQKGEIRVINQTTCENLLPQQITPRMMCVGFLSGGVDSCAGDSGGPLSSVEADGRIFQAGVVSWGDGCAQRNKPGVYTRLPLFRDWIKENTGV

SEQ ID NO: 671 - protein, 241 aa, Artificial Sequence
  MEMBRANE TYPE SERINE PROTEASE 1 (MT-SP1) protease domain I41T/Y60gL/N95D/D96F/F97S/F99L/C122S/Q175S/Q192A
VVGGTDADEGEWPWQVSLHALGQGHTCGASLISPNWLVSAAHCYIDDRGFRLSDPTQWTAFLGLHDQSQRSAPGVQERRLKRIISHPFFDFSTLDYDIALLELEKPAEYSSMVRPISLPDASHVFPAGKAIWVTGWGHTQYGGTGALILQKGEIRVINQTTCENLLPQSITPRMMCVGFLSGGVDSCAGDSGGPLSSVEADGRIFQAGVVSWGDGCAQRNKPGVYTRLPLFRDWIKENTGV

SEQ ID NO: 672 - protein, 241 aa, Artificial Sequence
  MEMBRANE TYPE SERINE PROTEASE 1 (MT-SP1) protease domain I41A/Y60gW/N95D/D96F/F97G/F99L/C122S/Q175H/Q192A
VVGGTDADEGEWPWQVSLHALGQGHACGASLISPNWLVSAAHCYIDDRGFRWSDPTQWTAFLGLHDQSQRSAPGVQERRLKRIISHPFFDFGTLDYDIALLELEKPAEYSSMVRPISLPDASHVFPAGKAIWVTGWGHTQYGGTGALILQKGEIRVINQTTCENLLPQHITPRMMCVGFLSGGVDSCAGDSGGPLSSVEADGRIFQAGVVSWGDGCAQRNKPGVYTRLPLFRDWIKENTGV

SEQ ID NO: 673 - protein, 241 aa, Artificial Sequence
  MEMBRANE TYPE SERINE PROTEASE 1 (MT-SP1) protease domain I41A/Y60gW/F99L/C122S/Q175T/Q192A
VVGGTDADEGEWPWQVSLHALGQGHACGASLISPNWLVSAAHCYIDDRGFRWSDPTQWTAFLGLHDQSQRSAPGVQERRLKRIISHPFFNDFTLDYDIALLELEKPAEYSSMVRPISLPDASHVFPAGKAIWVTGWGHTQYGGTGALILQKGEIRVINQTTCENLLPQTITPRMMCVGFLSGGVDSCAGDSGGPLSSVEADGRIFQAGVVSWGDGCAQRNKPGVYTRLPLFRDWIKENTGV

SEQ ID NO: 674 - protein, 242 aa, Artificial Sequence
  MEMBRANE TYPE SERINE PROTEASE 1 (MT-SP1) protease domain Q38M/I41T/D96M/ins97aH/C122S/G151E
VVGGTDADEGEWPWQVSLHALGMGHTCGASLISPNWLVSAAHCYIDDRGFRYSDPTQWTAFLGLHDQSQRSAPGVQERRLKRIISHPFFNMFHTFDYDIALLELEKPAEYSSMVRPISLPDASHVFPAGKAIWVTGWGHTQYGGTEALILQKGEIRVINQTTCENLLPQQITPRMMCVGFLSGGVDSCQGDSGGPLSSVEADGRIFQAGVVSWGDGCAQRNKPGVYTRLPLFRDWIKENTGV

SEQ ID NO: 675 - protein, 242 aa, Artificial Sequence
  MEMBRANE TYPE SERINE PROTEASE 1 (MT-SP1) protease domain Q38H/I41T/D96R/ins97aG/C122S/G151S
VVGGTDADEGEWPWQVSLHALGHGHTCGASLISPNWLVSAAHCYIDDRGFRYSDPTQWTAFLGLHDQSQRSAPGVQERRLKRIISHPFFNRFGTFDYDIALLELEKPAEYSSMVRPISLPDASHVFPAGKAIWVTGWGHTQYGGTSALILQKGEIRVINQTTCENLLPQQITPRMMCVGFLSGGVDSCQGDSGGPLSSVEADGRIFQAGVVSWGDGCAQRNKPGVYTRLPLFRDWIKENTGV

SEQ ID NO: 676 - protein, 242 aa, Artificial Sequence
  MEMBRANE TYPE SERINE PROTEASE 1 (MT-SP1) protease domain I41S/D60bY/ins97aV/T98N/C122S/Q192H
VVGGTDADEGEWPWQVSLHALGQGHSCGASLISPNWLVSAAHCYIDYRGFRYSDPTQWTAFLGLHDQSQRSAPGVQERRLKRIISHPFFNDFVNFDYDIALLELEKPAEYSSMVRPISLPDASHVFPAGKAIWVTGWGHTQYGGTGALILQKGEIRVINQTTCENLLPQQITPRMMCVGFLSGGVDSCHGDSGGPLSSVEADGRIFQAGVVSWGDGCAQRNKPGVYTRLPLFRDWIKENTGV

SEQ ID NO: 677 - protein, 242 aa, Artificial Sequence
  MEMBRANE TYPE SERINE PROTEASE 1 (MT-SP1) protease domain I41S/Y59F/D60bY/ins97aV/C122S/Q192G
VVGGTDADEGEWPWQVSLHALGQGHSCGASLISPNWLVSAAHCFIDYRGFRYSDPTQWTAFLGLHDQSQRSAPGVQERRLKRIISHPFFNDFVTFDYDIALLELEKPAEYSSMVRPISLPDASHVFPAGKAIWVTGWGHTQYGGTGALILQKGEIRVINQTTCENLLPQQITPRMMCVGFLSGGVDSCGGDSGGPLSSVEADGRIFQAGVVSWGDGCAQRNKPGVYTRLPLFRDWIKENTGV

SEQ ID NO: 678 - protein, 242 aa, Artificial Sequence
  MEMBRANE TYPE SERINE PROTEASE 1 (MT-SP1) protease domain I41S/D60bY/ins97aV/A112V/C122S/Q192G/Q209L
VVGGTDADEGEWPWQVSLHALGQGHSCGASLISPNWLVSAAHCYIDYRGFRYSDPTQWTAFLGLHDQSQRSAPGVQERRLKRIISHPFFNDFVTFDYDIALLELEKPVEYSSMVRPISLPDASHVFPAGKAIWVTGWGHTQYGGTGALILQKGEIRVINQTTCENLLPQQITPRMMCVGFLSGGVDSCGGDSGGPLSSVEADGRIFLAGVVSWGDGCAQRNKPGVYTRLPLFRDWIKENTGV

SEQ ID NO: 679 - protein, 242 aa, Artificial Sequence
  MEMBRANE TYPE SERINE PROTEASE 1 (MT-SP1) protease domain A35T/I41S/Y59F/ins97aV/C122S/Y146F/V183A/Q192G/R23 5H
VVGGTDADEGEWPWQVSLHTLGQGHSCGASLISPNWLVSAAHCFIDDRGFRYSDPTQWTAFLGLHDQSQRSAPGVQERRLKRIISHPFFNDFVTFDYDIALLELEKPAEYSSMVRPISLPDASHVFPAGKAIWVTGWGHTQFGGTGALILQKGEIRVINQTTCENLLPQQITPRMMCAGFLSGGVDSCGGDSGGPLSSVEADGRIFQAGVVSWGDGCAQRNKPGVYTRLPLFHDWIKENTGV

SEQ ID NO: 680 - protein, 242 aa, Artificial Sequence
  MEMBRANE TYPE SERINE PROTEASE 1 (MT-SP1) protease domain I41S/D96K/F97G/ins97aV/T98P/F99L/C122S/Q175H/Q192D
VVGGTDADEGEWPWQVSLHALGQGHSCGASLISPNWLVSAAHCYIDDRGFRYSDPTQWTAFLGLHDQSQRSAPGVQERRLKRIISHPFFNKGVPLDYDIALLELEKPAEYSSMVRPISLPDASHVFPAGKAIWVTGWGHTQYGGTGALILQKGEIRVINQTTCENLLPQHITPRMMCVGFLSGGVDSCDGDSGGPLSSVEADGRIFQAGVVSWGDGCAQRNKPGVYTRLPLFRDWIKENTGV

SEQ ID NO: 681 - protein, 242 aa, Artificial Sequence
  MEMBRANE TYPE SERINE PROTEASE 1 (MT-SP1) protease domain I41S/ins97aV/C122S/N164D/Q192G/R235H
VVGGTDADEGEWPWQVSLHALGQGHSCGASLISPNWLVSAAHCYIDDRGFRYSDPTQWTAFLGLHDQSQRSAPGVQERRLKRIISHPFFNDFVTFDYDIALLELEKPAEYSSMVRPISLPDASHVFPAGKAIWVTGWGHTQYGGTGALILQKGEIRVIDQTTCENLLPQQITPRMMCVGFLSGGVDSCGGDSGGPLSSVEADGRIFQAGVVSWGDGCAQRNKPGVYTRLPLFHDWIKENTGV

SEQ ID NO: 682 - protein, 242 aa, Artificial Sequence
  MEMBRANE TYPE SERINE PROTEASE 1 (MT-SP1) protease domain I41S/Y59F/ins97aV/C122S/Q192G/N223D
VVGGTDADEGEWPWQVSLHALGQGHSCGASLISPNWLVSAAHCFIDDRGFRYSDPTQWTAFLGLHDQSQRSAPGVQERRLKRIISHPFFNDFVTFDYDIALLELEKPAEYSSMVRPISLPDASHVFPAGKAIWVTGWGHTQYGGTGALILQKGEIRVINQTTCENLLPQQITPRMMCVGFLSGGVDSCGGDSGGPLSSVEADGRIFQAGVVSWGDGCAQRDKPGVYTRLPLFRDWIKENTGV

SEQ ID NO: 683 - protein, 242 aa, Artificial Sequence
  MEMBRANE TYPE SERINE PROTEASE 1 (MT-SP1) protease domain I41S/ins97aV/C122S/N164D/Q192G/R235L
VVGGTDADEGEWPWQVSLHALGQGHSCGASLISPNWLVSAAHCYIDDRGFRYSDPTQWTAFLGLHDQSQRSAPGVQERRLKRIISHPFFNDFVTFDYDIALLELEKPAEYSSMVRPISLPDASHVFPAGKAIWVTGWGHTQYGGTGALILQKGEIRVIDQTTCENLLPQQITPRMMCVGFLSGGVDSCGGDSGGPLSSVEADGRIFQAGVVSWGDGCAQRNKPGVYTRLPLFLDWIKENTGV

SEQ ID NO: 684 - protein, 242 aa, Artificial Sequence
  MEMBRANE TYPE SERINE PROTEASE 1 (MT-SP1) protease domain I41S/Y59F/F97Y/ins97aV/C122S/Q192G
VVGGTDADEGEWPWQVSLHALGQGHSCGASLISPNWLVSAAHCFIDDRGFRYSDPTQWTAFLGLHDQSQRSAPGVQERRLKRIISHPFFNDYVTFDYDIALLELEKPAEYSSMVRPISLPDASHVFPAGKAIWVTGWGHTQYGGTGALILQKGEIRVINQTTCENLLPQQITPRMMCVGFLSGGVDSCGGDSGGPLSSVEADGRIFQAGVVSWGDGCAQRNKPGVYTRLPLFRDWIKENTGV

SEQ ID NO: 685 - protein, 242 aa, Artificial Sequence
  MEMBRANE TYPE SERINE PROTEASE 1 (MT-SP1) protease domain I41S/D96K/F97G/ins97aV/T98P/F99L/C122S/Q192V
VVGGTDADEGEWPWQVSLHALGQGHSCGASLISPNWLVSAAHCYIDDRGFRYSDPTQWTAFLGLHDQSQRSAPGVQERRLKRIISHPFFNKGVPLDYDIALLELEKPAEYSSMVRPISLPDASHVFPAGKAIWVTGWGHTQYGGTGALILQKGEIRVINQTTCENLLPQQITPRMMCVGFLSGGVDSCVGDSGGPLSSVEADGRIFQAGVVSWGDGCAQRNKPGVYTRLPLFRDWIKENTGV

SEQ ID NO: 686 - protein, 241 aa, Artificial Sequence
  MEMBRANE TYPE SERINE PROTEASE 1 (MT-SP1) protease domain I41S/F99L/C122S/G151N/Q175M/Q192G/D217V
VVGGTDADEGEWPWQVSLHALGQGHSCGASLISPNWLVSAAHCYIDDRGFRYSDPTQWTAFLGLHDQSQRSAPGVQERRLKRIISHPFFNDFTLDYDIALLELEKPAEYSSMVRPISLPDASHVFPAGKAIWVTGWGHTQYGGTNALILQKGEIRVINQTTCENLLPQMITPRMMCVGFLSGGVDSCGGDSGGPLSSVEADGRIFQAGVVSWGVGCAQRNKPGVYTRLPLFRDWIKENTGV

SEQ ID NO: 687 - protein, 241 aa, Artificial Sequence
  MEMBRANE TYPE SERINE PROTEASE 1 (MT-SP1) protease domain I41S/F97L/F99L/C122S/G151N/Q192G/D217V
VVGGTDADEGEWPWQVSLHALGQGHSCGASLISPNWLVSAAHCYIDDRGFRYSDPTQWTAFLGLHDQSQRSAPGVQERRLKRIISHPFFNDLTLDYDIALLELEKPAEYSSMVRPISLPDASHVFPAGKAIWVTGWGHTQYGGTNALILQKGEIRVINQTTCENLLPQQITPRMMCVGFLSGGVDSCGGDSGGPLSSVEADGRIFQAGVVSWGVGCAQRNKPGVYTRLPLFRDWIKENTGV

SEQ ID NO: 688 - protein, 241 aa, Artificial Sequence
  MEMBRANE TYPE SERINE PROTEASE 1 (MT-SP1) protease domain I41S/F97S/F99L/C122S/G151N/Q175L/Q192A/D217L
VVGGTDADEGEWPWQVSLHALGQGHSCGASLISPNWLVSAAHCYIDDRGFRYSDPTQWTAFLGLHDQSQRSAPGVQERRLKRIISHPFFNDSTLDYDIALLELEKPAEYSSMVRPISLPDASHVFPAGKAIWVTGWGHTQYGGTNALILQKGEIRVINQTTCENLLPQLITPRMMCVGFLSGGVDSCAGDSGGPLSSVEADGRIFQAGVVSWGLGCAQRNKPGVYTRLPLFRDWIKENTGV

SEQ ID NO: 689 - protein, 241 aa, Artificial Sequence
  MEMBRANE TYPE SERINE PROTEASE 1 (MT-SP1) protease domain I41G/F97R/F99L/C122S/G151N/Q175L/Q192S/D217V
VVGGTDADEGEWPWQVSLHALGQGHGCGASLISPNWLVSAAHCYIDDRGFRYSDPTQWTAFLGLHDQSQRSAPGVQERRLKRIISHPFFNDRTLDYDIALLELEKPAEYSSMVRPISLPDASHVFPAGKAIWVTGWGHTQYGGTNALILQKGEIRVINQTTCENLLPQLITPRMMCVGFLSGGVDSCSGDSGGPLSSVEADGRIFQAGVVSWGVGCAQRNKPGVYTRLPLFRDWIKENTGV

SEQ ID NO: 690 - protein, 241 aa, Artificial Sequence; identical to SEQ ID NO: 6
  MEMBRANE TYPE SERINE PROTEASE 1 (MT-SP1) protease domain I41T/F97L/F99L/C122S/G151N/Q175S/Q192S/D217W

SEQ ID NO: 691 - protein, 241 aa, Artificial Sequence; identical to SEQ ID NO: 8
  MEMBRANE TYPE SERINE PROTEASE 1 (MT-SP1) protease domain I41D/F97T/F99M/C122S/Q192V/D217M

SEQ ID NO: 692 - protein, 444 aa, Artificial Sequence
  ATIII Bait (ATIII modified by insertion of QHARASHLG in the RSL loop)
HGSPVDICTAKPRDIPMNPMCIYRSPEKKATEDEGSEQKIPEATNRRVWELSKANSRFATTFYQHLADSKNDNDNIFLSPLSISTAFAMTKLGACNDTLQQLMEVFKFDTISEKTSDQIHFFFAKLNCRLYRKANKSSKLVSANRLFGDKSLTFNETYQDISELVYGAKLQPLDFKENAEQSRAAINKWVSNKTEGRITDVIPSEAINELTVLVLVNTIYFKGLWKSKFSPENTRKELFYKADGESCSASMMYQEGKFRYRRVAEGTQVLELPFKGDDITMVLILPKPEKSLAKVEKELTPEVLQEWLDELEEMMLVVHMPRFRIEDGFSLKEQLQDMGLVDLFSPEKSKLPGIVAEGRDDLYVSDAFHKAFLEVNEEGSEAAASTAVVQHARASHLGRVTFKANRPFLVFIREVPLNTIIFMGRVANPCVKGGGSDYKDDDDK

What is claimed:

1. A modified membrane type serine protease 1 (MTSP-1) polypeptide, comprising:
   a) an amino acid sequence having at least 80% sequence identity to SEQ ID NO: 1 or 3, wherein said amino acid sequence comprises one or more substitution(s) selected from Q637H and/or I640S (equivalent to Q38H and I41S, respectively, by chymotrypsin numbering), or
   b) an amino acid sequence having at least 80% sequence identity to SEQ ID NO: 2 or 4, wherein said amino acid sequence comprises one or more substitution(s) selected from Q23H and/or I26S (equivalent to Q38H and I41S, respectively, by chymotrypsin numbering); and
   optionally the modified MTSP-1 polypeptide further comprises one or more amino acid modifications selected from D60bT, F60eS or R, Y60gW, ins97aV, D96K, F97G, G151H or N and Q192T, by chymotrypsin numbering, wherein:
   i) the modified MTSP-1 polypeptide has increased activity/specificity for a complement protein compared to the unmodified active form of the MTSP-1 polypeptide comprising the amino acid sequence set forth in any of SEQ ID NOs: 1-4 or a catalytically active fragment or form thereof;
   ii) the amino acid modifications are selected from replacements, insertions and/or deletions in the unmodified MTSP-1 polypeptide;
   iii) the complement protein is C3; and
   iv) the modified MTSP-1 polypeptide cleaves a target site in C3 that inactivates C3 to thereby inhibit or reduce complement activation.

2. The modified MTSP-1 polypeptide of claim 1, wherein the target site in C3 comprises residues 737-744 of SEQ ID NO:9.

3. The modified MTSP-1 polypeptide of claim 2, wherein the cleavage is between residues 740 and 741 of SEQ ID NO:9, whereby cleavage occurs at Q H A R↓A S H L.

4. The modified MTSP-1 polypeptide of claim 1, wherein the unmodified MTSP-1 polypeptide consists of the sequence of amino acids set forth in any of SEQ ID NOs:1-4.

5. The modified MTSP-1 polypeptide of claim 1, wherein the unmodified MTSP-1 polypeptide consists of the sequence of amino acids set forth in SEQ ID NO:4.

6. The modified MTSP-1 polypeptide of claim 1, wherein the modified MTSP-1 polypeptide has 1 or up to 2, 3, 4, 5, 6, 7, 8, 9, 10, 11, 12, 13, 14 or 15 amino acid replacements, insertions or deletions, compared to the unmodified MTSP-1 polypeptide of any of SEQ ID NOs: 1-4 or a catalytically active portion thereof.

7. The modified MTSP-1 polypeptide of claim 1, further comprising one or more modifications corresponding to D60bT, F60eS, Y60gW, F97G, ins97aV, D96K, T98P, F99L, G151H, Q175L or Q192D, by chymotrypsin numbering.

8. The modified MTSP-1 polypeptide of claim 1, comprising modifications corresponding to any of:
   Q38H/I41S/D60bT/F60eS/Y60gW/D96K/F97G/ins97aV/T98P/F99L/C122S/G151H/Q175L/Q192D, or
   Q38H/I41A/D60bV/F60eR/Y60gW/F97T/ins97aE/T98G/F99L/C122S/G151N/Q175 L/Q192D, or
   Q38H/I41A/D60bT/F60eK/Y60gW/F97T/ins97aE/T98G/F99L/C122S/G151N/Q175 L/Q192D, or
   Q38H/I41S/D60bT/F60eS/Y60gW/F97D/ins97aV/T98P/F99L/C122S/G151H/Q175L/Q192E, or
   Q38H/I41S/D60bT/F60eS/Y60gW/F97D/ins97aV/T98P/F99L/C122S/G151H/Q175L/Q192D, or
   Q38H/I41A/D60bT/F60eK/Y60gW/F97T/ins97aE/T98G/F99L/C122S/G151H/Q175 L/Q192D, or
   Q38H/I41S/D60bT/F60eS/Y60gW/F97D/ins97aV/T98P/F99L/C122S/G151N/Q175L/Q192D, or
   Q38H/I41A/D60bV/F60eR/Y60gW/F97T/ins97aE/T98G/F99L/C122S/G151H/Q175 L/Q192D, or
   Q38H/I41A/D60bV/F60eR/Y60gW/D96I/F97Y/ins97aN/T98G/F99L/C122S/G151N/Q175L/Q192D, or
   Q38H/I41S/D60bT/F60eS/Y60gW/D96K/F97D/ins97aA/T98P/F99L/C122S/G151H/Q175L/Q192D, or
   Q38H/I41A/D60bV/F60eR/Y60gW/D96P/F97W/ins97aN/T98G/F99L/C122S/G151N/Q175L/Q192E, or
   Q38H/I41A/D60bV/F60eR/Y60gW/D96I/F97N/T98G/F99L/C122S/G151N/Q175L/Q192D, or
   Q38H/I41S/D60bT/F60eS/Y60gW/D96Y/F97E/ins97aV/T98G/F99L/C122S/G151H/Q175L/Q192D, or
   Q38H/I41S/D60bT/F60eS/Y60gW/D96L/F97D/ins97aG/T98N/F99L/C122S/G151H/Q175L/Q192E, or
   Q38H/I41S/D60bT/F60eS/Y60gW/D96V/F97G/ins97aV/T98P/F99L/C122S/G151H/Q175L/Q192D, or
   Q38H/I41S/D60bT/F60eS/Y60gW/D96K/F97D/ins97aA/T98P/F99L/C122S/G151N/Q175L/Q192D, or
   Q38H/I41S/D60bT/F60eS/Y60gW/F97G/ins97aV/T98P/F99L/C122S/G151H/Q175L/Q192D, or
   Q38H/I41S/D60bT/F60eS/Y60gW/D96K/ins97aV/T98P/F99L/C122S/G151H/Q175L/Q192D, or
   Q38H/I41S/D60bT/F60eS/Y60gW/D96K/F97G/ins97aV/T98P/F99L/C122S/G151H/Q175L, or
   I41S/F99L/C122S/G151N/Q192V, or
   I41S/D60bT/F60eS/Y60gW/D96K/F97G/ins97aV/T98P/F99L/C122S/G151H/Q175L/Q192D, or
   Q38H/D60bT/F60eS/Y60gW/D96K/F97G/ins97aV/T98P/F99L/C122S/G151H/Q175 L/Q192D, or
   Q38H/I41S/F60eS/Y60gW/D96K/F97G/ins97aV/T98P/F99L/C122S/G151H/Q175L/Q192D, or
   Q38H/I41S/D60bT/Y60gW/D96K/F97G/ins97aV/T98P/F99L/C122S/G151H/Q175L/Q192D, or
   Q38H/I41S/D60bT/F60eS/D96K/F97G/ins97aV/T98P/F99L/C122S/G151H/Q175L/Q192D, or
   Q38H/I41S/D60bT/F60eS/Y60gW/D96K/F97G/T98P/F99L/C122S/G151H/Q175L/Q 192D, or
   Q38H/I41S/D60bT/F60eS/Y60gW/D96K/F97G/ins97aV/F99L/C122S/G151H/Q175 L/Q192D, or
   Q38H/I41S/D60bT/F60eS/Y60gW/D96K/F97G/ins97aV/T98P/C122S/G151H/Q175 L/Q192D, or
   Q38H/I41S/D60bT/F60eS/Y60gW/D96K/F97G/ins97aV/T98P/F99L/C122S/Q175L/Q192D, or
   Q38H/I41S/D60bT/F60eS/Y60gW/D96K/F97G/ins97aV/T98P/F99L/C122S/G151H/Q192D, or
   Q38H/I41S/D96K/F97G/ins97aV/T98P/F99L/C122S/Q192D, or
   I41S/D96K/F97G/ins97aV/T98P/F99L/C122S/Q175L/Q192D, or
   I41S/D96K/F97G/ins97aV/T98P/F99L/C122S/Q192D, or
   Q38H/I41S/D96K/F97G/ins97aV/T98P/F99L/C122S/Q175L/Q192D, or Q38H/I41S/D60bY/D96K/F97G/ins97aV/T98P/F99L/ C122S/Q192D/D217V, or
I41S/D96K/F97G/ins97aV/T98P/F99L/C122S/Q192G/ D217V, or
I41S/D60bY/D96K/F97G/ins97aV/T98P/F99L/C122S/ Q192D/D217V, or
I41S/D96M/F97G/ins97aV/T98P/F99L/C122S/Q192G/ D217V, or
I41S/D96K/F97G/ins97aV/T98P/F99L/C122S/Q192V/ D217I, or
I41S/D96K/F97G/ins97aV/T98P/F99L/C122S/Q192H, or
I41S/D96K/F97G/ins97aV/T98P/F99L/C122S/Q192N/ D217V, or
I41S/D60bY/D96K/F97G/ins97aV/T98P/F99L/C122S/ Q175L/Q192D, or
Q38H/I41S/D96K/F97G/ins97aV/T98P/F99L/C122S/Q192G/D217V, or
I41S/D96K/F97G/ins97aV/T98P/F99L/C122S/Q175L/Q192V, or
I41S/P49S/D96K/F97G/ins97aV/T98P/F99L/C122S/Q192G/D217V, or
I41S/D96K/F97 G/ins97aV/T98P/F99L/C122S/Q175L/Q192N/D217V, or
I41T/F97W/F99L/C122S/G151N/Q175M/Q192G/D217L, or
I41G/F97L/F99L/C122S/Q175A/Q192T/D217V, or
I41G/F97V/F99L/C122S/G151Q/Q175M/Q192A/D217L, or
I41G/F971/F99L/C122S/G151L/Q175M/Q192S/D217V, or
I41G/F97S/F99L/C122S/G151N/Q175L/Q192G/D2171, or
I41T/F97L/F99L/C122S/G151N/Q175S/Q192S/D217W, or
I41D/F97T/F99M/C122S/Q192V/D217M, or the same modifications except C122S is not modified and is C122C, by chymotrypsin numbering.

9. The modified MTSP-1 polypeptide of claim 1, comprising modifications selected from among combinations that include one or more of modifications Q38H, I41S, D60bT, F60eS, Y60gW, D96K, F97G, Ins97aV and G151H, by chymotrypsin numbering, as follows: G151H, Ins97aV, Ins97aV/G151H, F97G, F97G/G151H, F97G/Ins97aV, F97G/Ins97aV/G151H, D96K, D96K/G151H, D96K/Ins97aV, D96K/Ins97aV/G151H, D96K/F97G, D96K/F97G/G151H, D96K/F97G/Ins97aV, D96K/F97G/Ins97aV/G151H, Y60gW, Y60gW/G151H, Y60gW/Ins97aV, Y60gW/Ins97aV/G151H, Y60gW/F97G, Y60gW/F97G/G151H, Y60gW/F97G/Ins97aV, Y60gW/F97G/Ins97aV/G151H, Y60gW/D96K, Y60gW/D96K/G151H, Y60gW/D96K/Ins97aV, Y60gW/D96K/Ins97aV/G151H, Y60gW/D96K/F97G, Y60gW/D96K/F97G/G151H, Y60gW/D96K/F97G/Ins97aV, Y60gW/D96K/F97G/Ins97aV/G151H, F60eS, F60eS/G151H, F60eS/Ins97aV, F60eS/Ins97aV/G151H, F60eS/F97G, F60eS/F97G/G151H, F60eS/F97G/Ins97aV, F60eS/F97G/Ins97aV/G151H, F60eS/D96K, F60eS/D96K/G151H, F60eS/D96K/Ins97aV, F60eS/D96K/Ins97aV/G151H, F60eS/D96K/F97G, F60eS/D96K/F97G/G151H, F60eS/D96K/F97G/Ins97aV, F60eS/D96K/F97G/Ins97aV/G151H, F60eS/Y60gW, F60eS/Y60gW/G151H, F60eS/Y60gW/Ins97aV, F60eS/Y60gW/Ins97aV/G151H, F60eS/Y60gW/F97G, F60eS/Y60gW/F97G/G151H, F60eS/Y60gW/F97G/Ins97aV, F60eS/Y60gW/F97G/Ins97aV/G151H, F60eS/Y60gW/D96K, F60eS/Y60gW/D96K/G151H, F60eS/Y60gW/D96K/Ins97aV, F60eS/Y60gW/D96K/Ins97aV/G151H, F60eS/Y60gW/D96K/F97G, F60eS/Y60gW/D96K/F97G/G151H, F60eS/Y60gW/D96K/F97G/Ins97aV, F60eS/Y60gW/D96K/F97G/Ins97aV/G151H, D60bT, D60bT/G151H, D60bT/Ins97aV, D60bT/Ins97aV/G151H, D60bT/F97G, D60bT/F97G/G151H, D60bT/F97G/Ins97aV, D60bT/F97G/Ins97aV/G151H, D60bT/D96K, D60bT/D96K/G151H, D60bT/D96K/Ins97aV, D60bT/D96K/Ins97aV/G151H, D60bT/D96K/F97G, D60bT/D96K/F97G/G151H, D60bT/D96K/F97G/Ins97aV, D60bT/D96K/F97G/Ins97aV/G151H, D60bT/Y60gW, D60bT/Y60gW/G151H, D60bT/Y60gW/Ins97aV, D60bT/Y60gW/Ins97aV/G151H, D60bT/Y60gW/F97G, D60bT/Y60gW/F97G/G151H, D60bT/Y60gW/F97G/Ins97aV, D60bT/Y60gW/F97G/Ins97aV/G151H, D60bT/Y60gW/D96K, D60bT/Y60gW/D96K/G151H, D60bT/Y60gW/D96K/Ins97aV, D60bT/Y60gW/D96K/Ins97aV/G151H, D60bT/Y60gW/D96K/F97G, D60bT/Y60gW/D96K/F97G/G151H, D60bT/Y60gW/D96K/F97G/Ins97aV, D60bT/Y60gW/D96K/F97G/Ins97aV/G151H, D60bT/F60eS, D60bT/F60eS/G151H, D60bT/F60eS/Ins97aV, D60bT/F60eS/Ins97aV/G151H, D60bT/F60eS/F97G, D60bT/F60eS/F97G/G151H, D60bT/F60eS/F97G/Ins97aV, D60bT/F60eS/F97G/Ins97aV/G151H, D60bT/F60eS/D96K, D60bT/F60eS/D96K/G151H, D60bT/F60eS/D96K/Ins97aV, D60bT/F60eS/D96K/Ins97aV/G151H, D60bT/F60eS/D96K/F97G, D60bT/F60eS/D96K/F97G/G151H, D60bT/F60eS/D96K/F97G/Ins97aV, D60bT/F60eS/D96K/F97G/Ins97aV/G151H, D60bT/F60eS/Y60gW, D60bT/F60eS/Y60gW/G151H, D60bT/F60eS/Y60gW/Ins97aV, D60bT/F60eS/Y60gW/Ins97aV/G151H, D60bT/F60eS/Y60gW/F97G, D60bT/F60eS/Y60gW/F97G/G151H, D60bT/F60eS/Y60gW/F97G/Ins97aV, D60bT/F60eS/Y60gW/F97G/Ins97aV/G151H, D60bT/F60eS/Y60gW/D96K, D60bT/F60eS/Y60gW/D96K/G151H, D60bT/F60eS/Y60gW/D96K/Ins97aV, D60bT/F60eS/Y60gW/D96K/Ins97aV/G151H, D60bT/F60eS/Y60gW/D96K/F97G, D60bT/F60eS/Y60gW/D96K/F97G/G151H, D60bT/F60eS/Y60gW/D96K/F97G/Ins97aV, D60bT/F60eS/Y60gW/D96K/F97G/Ins97aV/G151H, I41S, I41S/G151H, I41S/Ins97aV, I41S/Ins97aV/G151H, I41S/F97G, I41S/F97G/G151H, I41S/F97G/Ins97aV, I41S/F97G/Ins97aV/G151H, I41S/D96K, I41S/D96K/G151H, I41S/D96K/Ins97aV, I41S/D96K/Ins97aV/G151H, I41S/D96K/F97G, I41S/D96K/F97G/G151H, I41S/D96K/F97G/Ins97aV, I41S/D96K/F97G/Ins97aV/G151H, I41S/Y60gW, I41S/Y60gW/G151H, I41S/Y60gW/Ins97aV, I41S/Y60gW/Ins97aV/G151H, I41S/Y60gW/F97G, I41S/Y60gW/F97G/G151H, I41S/Y60gW/F97G/Ins97aV, I41S/Y60gW/F97G/Ins97aV/G151H, I41S/Y60gW/D96K, I41S/Y60gW/D96K/G151H, I41S/Y60gW/D96K/Ins97aV, I41S/Y60gW/D96K/Ins97aV/G151H, I41S/Y60gW/D96K/F97G, I41S/Y60gW/D96K/F97G/G151H, I41S/Y60gW/D96K/F97G/Ins97aV, I41S/Y60gW/D96K/F97G/Ins97aV/G151H, I41S/F60eS, I41S/F60eS/G151H, I41S/F60eS/Ins97aV, I41S/F60eS/Ins97aV/G151H, I41S/F60eS/F97G, I41S/F60eS/F97G/G151H, I41S/F60eS/F97G/Ins97aV, I41S/F60eS/F97G/Ins97aV/G151H, I41S/F60eS/D96K, I41S/F60eS/D96K/G151H, I41S/F60eS/D96K/Ins97aV, I41S/F60eS/D96K/Ins97aV/G151H, I41S/F60eS/D96K/F97G, I41S/F60eS/D96K/F97G/G151H, I41S/F60eS/D96K/F97G/Ins97aV, I41S/F60eS/D96K/F97G/Ins97aV/G151H, I41S/F60eS/Y60gW, I41S/F60eS/Y60gW/G151H, I41S/F60eS/Y60gW/Ins97aV, I41S/F60eS/Y60gW/Ins97aV/G151H, I41S/F60eS/Y60gW/F97G, I41S/F60eS/Y60gW/F97G/G151H, I41S/F60eS/Y60gW/F97G/Ins97aV, I41S/F60eS/Y60gW/F97G/Ins97aV/G151H, I41S/F60eS/Y60gW/D96K, I41S/F60eS/Y60gW/D96K/G151H, I41S/F60eS/Y60gW/D96K/Ins97aV, I41S/F60eS/Y60gW/D96K/Ins97aV/G151H, I41S/F60eS/Y60gW/D96K/F97G, I41S/F60eS/Y60gW/D96K/F97G/G151H, I41S/F60eS/Y60gW/D96K/F97G/Ins97aV, I41S/F60eS/Y60gW/D96K/F97G/Ins97aV/G151H, I41S/D60bT, I41S/D60bT/G151H, I41S/D60bT/Ins97aV, I41S/D60bT/Ins97aV/G151H, I41S/D60bT/F97G, I41S/D60bT/F97G/G151H, I41S/D60bT/F97G/Ins97aV, I41S/D60bT/F97G/Ins97aV/G151H, I41S/D60bT/D96K, I41S/D60bT/D96K/G151H, I41S/D60bT/D96K/Ins97aV, I41S/D60bT/D96K/Ins97aV/G151H, I41S/D60bT/D96K/F97G, I41S/D60bT/D96K/F97G/G151H, I41S/D60bT/D96K/F97G/Ins97aV, I41S/D60bT/D96K/F97G/Ins97aV/G151H, I41S/D60bT/Y60gW, I41S/D60bT/Y60gW/G151H, I41S/D60bT/Y60gW/Ins97aV, I41S/D60bT/Y60gW/Ins97aV/G151H, I41S/D60bT/Y60gW/F97G, I41S/D60bT/Y60gW/F97G/G151H, I41S/D60bT/Y60gW/F97G/Ins97aV, I41S/D60bT/Y60gW/F97G/Ins97aV/G151H, I41S/D60bT/Y60gW/D96K, I41S/D60bT/Y60gW/D96K/G151H, I41S/D60bT/Y60gW/D96K/Ins97aV, I41S/D60bT/Y60gW/D96K/Ins97aV/G151H, I41S/D60bT/Y60gW/D96K/F97G, I41S/D60bT/Y60gW/D96K/F97G/G151H, I41S/D60bT/Y60gW/D96K/F97G/Ins97aV, I41S/D60bT/Y60gW/D96K/F97G/Ins97aV/G151H, I41S/D60bT/F60eS, I41S/D60bT/F60eS/G151H, I41S/D60bT/F60eS/Ins97aV, I41S/D60bT/F60eS/Ins97aV/G151H, I41S/D60bT/F60eS/F97G, I41S/D60bT/F60eS/F97G/G151H, I41S/D60bT/F60eS/F97G/Ins97aV, I41S/D60bT/F60eS/F97G/Ins97aV/G151H, I41S/D60bT/F60eS/D96K, I41S/D60bT/F60eS/D96K/G151H, I41S/D60bT/F60eS/D96K/Ins97aV, I41S/D60bT/F60eS/D96K/Ins97aV/G151H, I41S/D60bT/F60eS/D96K/F97G, I41S/D60bT/F60eS/D96K/F97G/G151H, I41S/D60bT/F60eS/D96K/F97G/Ins97aV, I41S/D60bT/F60eS/D96K/F97G/Ins97aV/G151H, I41S/D60bT/F60eS/Y60gW, I41S/D60bT/F60eS/Y60gW/G151H, I41S/D60bT/F60eS/Y60gW/Ins97aV, I41S/D60bT/F60eS/Y60gW/Ins97aV/G151H, I41S/D60bT/F60eS/Y60gW/F97G, I41S/D60bT/F60eS/Y60gW/F97G/G151H, I41S/D60bT/F60eS/Y60gW/F97G/Ins97aV, I41S/D60bT/F60eS/Y60gW/F97G/Ins97aV/G151H, I41S/D60bT/F60eS/Y60gW/D96K, I41S/D60bT/F60eS/Y60gW/D96K/G151H, I41S/D60bT/F60eS/Y60gW/D96K/Ins97aV, I41S/D60bT/F60eS/Y60gW/D96K/Ins97aV/G151H, I41S/D60bT/F60eS/Y60gW/D96K/F97G, I41S/D60bT/F60eS/Y60gW/D96K/F97G/G151H, I41S/D60bT/F60eS/Y60gW/D96K/F97G/Ins97aV, I41S/D60bT/F60eS/Y60gW/D96K/F97G/Ins97aV/G151H, Q38H, Q38H/G151H, Q38H/Ins97aV, Q38H/Ins97aV/G151H, Q38H/F97G, Q38H/F97G/G151H, Q38H/F97G/Ins97aV, Q38H/F97G/Ins97aV/G151H, Q38H/D96K, Q38H/D96K/G151H, Q38H/D96K/Ins97aV, Q38H/D96K/Ins97aV/G151H, Q38H/D96K/F97G, Q38H/D96K/F97G/G151H, Q38H/D96K/F97G/Ins97aV, Q38H/D96K/F97G/Ins97aV/G151H, Q38H/Y60gW, Q38H/Y60gW/G151H, Q38H/Y60gW/Ins97aV, Q38H/Y60gW/Ins97aV/G151H, Q38H/Y60gW/F97G, Q38H/Y60gW/F97G/G151H, Q38H/Y60gW/F97G/Ins97aV, Q38H/Y60gW/F97G/Ins97aV/G151H, Q38H/Y60gW/D96K, Q38H/Y60gW/D96K/G151H, Q38H/Y60gW/D96K/Ins97aV, Q38H/Y60gW/D96K/Ins97aV/G151H, Q38H/Y60gW/D96K/F97G, Q38H/Y60gW/D96K/F97G/G151H, Q38H/Y60gW/D96K/F97G/Ins97aV, Q38H/Y60gW/D96K/F97G/Ins97aV/G151H, Q38H/F60eS, Q38H/F60eS/G151H, Q38H/F60eS/Ins97aV, Q38H/F60eS/Ins97aV/G151H, Q38H/F60eS/F97G, Q38H/F60eS/F97G/G151H, Q38H/F60eS/F97G/Ins97aV, Q38H/F60eS/F97G/Ins97aV/G151H, Q38H/F60eS/D96K, Q38H/F60eS/D96K/G151H, Q38H/F60eS/D96K/Ins97aV, Q38H/F60eS/D96K/Ins97aV/G151H, Q38H/F60eS/D96K/F97G, Q38H/F60eS/D96K/F97G/G151H, Q38H/F60eS/D96K/F97G/Ins97aV, Q38H/F60eS/D96K/F97G/Ins97aV/G151H, Q38H/F60eS/Y60gW, Q38H/F60eS/Y60gW/G151H, Q38H/F60eS/Y60gW/Ins97aV, Q38H/F60eS/Y60gW/Ins97aV/G151H, Q38H/F60eS/Y60gW/F97G, Q38H/F60eS/Y60gW/F97G/G151H, Q38H/F60eS/Y60gW/F97G/Ins97aV, Q38H/F60eS/Y60gW/F97G/Ins97aV/G151H, Q38H/F60eS/Y60gW/D96K, Q38H/F60eS/Y60gW/D96K/G151H, Q38H/F60eS/Y60gW/D96K/Ins97aV, Q38H/F60eS/Y60gW/D96K/Ins97aV/G151H, Q38H/F60eS/Y60gW/D96K/F97G, Q38H/F60eS/Y60gW/D96K/F97G/G151H, Q38H/F60eS/Y60gW/D96K/F97G/Ins97aV, Q38H/F60eS/Y60gW/D96K/F97G/Ins97aV/G151H, Q38H/D60bT, Q38H/D60bT/G151H, Q38H/D60bT/Ins97aV, Q38H/D60bT/Ins97aV/G151H, Q38H/D60bT/F97G, Q38H/D60bT/F97G/G151H, Q38H/D60bT/F97G/Ins97aV, Q38H/D60bT/F97G/Ins97aV/G151H, Q38H/D60bT/D96K, Q38H/D60bT/D96K/G151H, Q38H/D60bT/D96K/Ins97aV, Q38H/D60bT/D96K/Ins97aV/G151H, Q38H/D60bT/D96K/F97G, Q38H/D60bT/D96K/F97G/G151H, Q38H/D60bT/D96K/F97G/Ins97aV, Q38H/D60bT/D96K/F97G/Ins97aV/G151H, Q38H/D60bT/Y60gW, Q38H/D60bT/Y60gW/G151H, Q38H/D60bT/Y60gW/Ins97aV, Q38H/D60bT/Y60gW/Ins97aV/G151H, Q38H/D60bT/Y60gW/F97G, Q38H/D60bT/Y60gW/F97G/G151H, Q38H/D60bT/Y60gW/F97G/Ins97aV, Q38H/D60bT/Y60gW/F97G/Ins97aV/G151H, Q38H/D60bT/Y60gW/D96K, Q38H/D60bT/Y60gW/D96K/G151H, Q38H/D60bT/Y60gW/D96K/Ins97aV, Q38H/D60bT/Y60gW/D96K/Ins97aV/G151H, Q38H/D60bT/Y60gW/D96K/F97G, Q38H/D60bT/Y60gW/D96K/F97G/G151H, Q38H/D60bT/Y60gW/D96K/F97G/Ins97aV, Q38H/D60bT/Y60gW/D96K/F97G/Ins97aV/G151H, Q38H/D60bT/F60eS, Q38H/D60bT/F60eS/G151H, Q38H/D60bT/F60eS/Ins97aV, Q38H/D60bT/F60eS/Ins97aV/G151H, Q38H/D60bT/F60eS/F97G, Q38H/D60bT/F60eS/F97G/G151H, Q38H/D60bT/F60eS/F97G/Ins97aV, Q38H/D60bT/F60eS/F97G/Ins97aV/G151H, Q38H/D60bT/F60eS/D96K, Q38H/D60bT/F60eS/D96K/G151H, Q38H/D60bT/F60eS/D96K/Ins97aV, Q38H/D60bT/F60eS/D96K/Ins97aV/G151H, Q38H/D60bT/F60eS/D96K/F97G, Q38H/D60bT/F60eS/D96K/F97G/G151H, Q38H/D60bT/F60eS/D96K/F97G/Ins97aV, Q38H/D60bT/F60eS/D96K/F97G/Ins97aV/G151H, Q38H/D60bT/F60eS/Y60gW, Q38H/D60bT/F60eS/Y60gW/G151H, Q38H/D60bT/F60eS/Y60gW/Ins97aV, Q38H/D60bT/F60eS/Y60gW/Ins97aV/G151H, Q38H/D60bT/F60eS/Y60gW/F97G, Q38H/D60bT/F60eS/Y60gW/F97G/G151H, Q38H/D60bT/F60eS/Y60gW/F97G/Ins97aV, Q38H/D60bT/F60eS/Y60gW/F97G/Ins97aV/G151H, Q38H/D60bT/F60eS/Y60gW/D96K, Q38H/D60bT/F60eS/Y60gW/D96K/G151H, Q38H/D60bT/F60eS/Y60gW/D96K/Ins97aV, Q38H/D60bT/F60eS/Y60gW/D96K/Ins97aV/G151H, Q38H/D60bT/F60eS/Y60gW/D96K/F97G, Q38H/D60bT/F60eS/Y60gW/D96K/F97G/G151H, Q38H/D60bT/F60eS/Y60gW/D96K/F97G/Ins97aV, Q38H/D60bT/F60eS/Y60gW/D96K/F97G/Ins97aV/G151H, Q38H/I41 S, Q38H/I41S/G151H, Q38H/I41S/Ins97aV, Q38H/I41S/Ins97aV/G151H, Q38H/I41S/F97G, Q38H/I41S/F97G/G151H, Q38H/I41S/F97G/Ins97aV, Q38H/I41S/F97G/Ins97aV/G151H, Q38H/I41S/D96K, Q38H/I41S/D96K/G151H, Q38H/I41S/D96K/Ins97aV, Q38H/I41S/D96K/Ins97aV/G151H, Q38H/I41S/D96K/F97G, Q38H/I41S/D96K/F97G/G151H, Q38H/I41S/D96K/F97G/Ins97aV, Q38H/I41S/D96K/F97G/Ins97aV/G151H, Q38H/I41S/Y60gW, Q38H/I41S/Y60gW/G151H, Q38H/I41S/Y60gW/Ins97aV, Q38H/I41S/Y60gW/Ins97aV/G151H, Q38H/I41S/Y60gW/F97G, Q38H/I41S/Y60gW/F97G/G151H, Q38H/I41S/Y60gW/F97G/Ins97aV, Q38H/I41S/Y60gW/F97G/Ins97aV/G151H, Q38H/I41S/Y60gW/D96K, Q38H/I41S/Y60gW/D96K/G151H, Q38H/I41S/Y60gW/D96K/Ins97aV, Q38H/I41S/Y60gW/D96K/Ins97aV/G151H, Q38H/I41S/Y60gW/D96K/F97G, Q38H/I41S/Y60gW/D96K/F97G/G151H, Q38H/I41S/Y60gW/D96K/F97G/Ins97aV, Q38H/I41S/Y60gW/D96K/F97G/Ins97aV/G151H, Q38H/I41S/F60eS, Q38H/I41S/F60eS/G151H, Q38H/I41S/F60eS/Ins97aV, Q38H/I41S/F60eS/Ins97aV/G151H, Q38H/I41S/F60eS/F97G, Q38H/I41S/F60eS/F97G/G151H, Q38H/I41S/F60eS/F97G/Ins97aV, Q38H/I41S/F60eS/F97G/Ins97aV/G151H, Q38H/I41S/F60eS/D96K, Q38H/I41S/F60eS/D96K/G151H, Q38H/I41S/F60eS/D96K/Ins97aV, Q38H/I41S/F60eS/D96K/Ins97aV/G151H, Q38H/I41S/F60eS/D96K/F97G, Q38H/I41S/F60eS/D96K/F97G/G151H, Q38H/I41S/F60eS/D96K/F97G/Ins97aV, Q38H/I41S/F60eS/D96K/F97G/Ins97aV/G151H, Q38H/I41S/F60eS/Y60gW, Q38H/I41S/F60eS/Y60gW/G151H, Q38H/I41S/F60eS/Y60gW/Ins97aV, Q38H/I41S/F60eS/Y60gW/Ins97aV/G151H, Q38H/I41S/F60eS/Y60gW/F97G, Q38H/I41S/F60eS/Y60gW/F97G/G151H, Q38H/I41S/F60eS/Y60gW/F97G/Ins97aV, Q38H/I41S/F60eS/Y60gW/F97G/Ins97aV/G151H, Q38H/I41S/F60eS/Y60gW/D96K, Q38H/I41S/F60eS/Y60gW/D96K/G151H, Q38H/I41S/F60eS/Y60gW/D96K/Ins97aV, Q38H/I41S/F60eS/Y60gW/D96K/Ins97aV/G151H, Q38H/I41S/F60eS/Y60gW/D96K/F97G, Q38H/I41S/F60eS/Y60gW/D96K/F97G/G151H, Q38H/I41S/F60eS/Y60gW/D96K/F97G/Ins97aV, Q38H/I41S/F60eS/Y60gW/D96K/F97G/Ins97aV/G151H, Q38H/I41S/D60bT, Q38H/I41S/D60bT/G151H, Q38H/I41S/D60bT/Ins97aV, Q38H/I41S/D60bT/Ins97aV/G151H, Q38H/I41S/D60bT/F97G, Q38H/I41S/D60bT/F97G/G151H, Q38H/I41S/D60bT/F97G/Ins97aV, Q38H/I41S/D60bT/F97G/Ins97aV/G151H, Q38H/I41S/D60bT/D96K, Q38H/I41S/D60bT/D96K/G151H, Q38H/I41S/D60bT/D96K/Ins97aV, Q38H/I41S/D60bT/D96K/Ins97aV/G151H, Q38H/I41S/D60bT/D96K/F97G, Q38H/I41S/D60bT/D96K/F97G/G151H, Q38H/I41S/D60bT/D96K/F97G/Ins97aV, Q38H/I41S/D60bT/D96K/F97G/Ins97aV/G151H, Q38H/I41S/D60bT/Y60gW, Q38H/I41S/D60bT/Y60gW/G151H, Q38H/I41S/D60bT/Y60gW/Ins97aV, Q38H/I41S/D60bT/Y60gW/Ins97aV/G151H, Q38H/I41S/D60bT/Y60gW/F97G, Q38H/I41S/D60bT/Y60gW/F97G/G151H, Q38H/I41S/D60bT/Y60gW/F97G/Ins97aV, Q38H/I41S/D60bT/Y60gW/F97G/Ins97aV/G151H, Q38H/I41S/D60bT/Y60gW/D96K, Q38H/I41S/D60bT/Y60gW/D96K/G151H, Q38H/I41S/D60bT/Y60gW/D96K/Ins97aV, Q38H/I41S/D60bT/Y60gW/D96K/Ins97aV/G151H, Q38H/I41S/D60bT/Y60gW/D96K/F97G, Q38H/I41S/D60bT/Y60gW/D96K/F97G/G151H, Q38H/I41S/D60bT/Y60gW/D96K/F97G/Ins97aV, Q38H/I41S/D60bT/Y60gW/D96K/F97G/Ins97aV/G151H, Q38H/I41S/D60bT/F60eS, Q38H/I41S/D60bT/F60eS/G151H, Q38H/I41S/D60bT/F60eS/Ins97aV, Q38H/I41S/D60bT/F60eS/Ins97aV/G151H, Q38H/I41S/D60bT/F60eS/F97G, Q38H/I41S/D60bT/F60eS/F97G/G151H, Q38H/I41S/D60bT/F60eS/F97G/Ins97aV, Q38H/I41S/D60bT/F60eS/F97G/Ins97aV/G151H, Q38H/I41S/D60bT/F60eS/D96K, Q38H/I41S/D60bT/F60eS/D96K/G151H, Q38H/I41S/D60bT/F60eS/D96K/Ins97aV, Q38H/I41S/D60bT/F60eS/D96K/Ins97aV/G151H, Q38H/I41S/D60bT/F60eS/D96K/F97G, Q38H/I41S/D60bT/F60eS/D96K/F97G/G151H, Q38H/I41S/D60bT/F60eS/D96K/F97G/Ins97aV, Q38H/I41S/D60bT/F60eS/D96K/F97G/Ins97aV/G151H, Q38H/I41S/D60bT/F60eS/Y60gW, Q38H/I41S/D60bT/F60eS/Y60gW/G151H, Q38H/I41S/D60bT/F60eS/Y60gW/Ins97aV, Q38H/I41S/D60bT/F60eS/Y60gW/Ins97aV/G151H, Q38H/I41S/D60bT/F60eS/Y60gW/F97G, Q38H/I41S/D60bT/F60eS/Y60gW/F97G/G151H, Q38H/I41S/D60bT/F60eS/Y60gW/F97G/Ins97aV, Q38H/I41S/D60bT/F60eS/Y60gW/F97G/Ins97aV/G151H, Q38H/I41S/D60bT/F60eS/Y60gW/D96K, Q38H/I41S/D60bT/F60eS/Y60gW/D96K/G151H, Q38H/I41S/D60bT/F60eS/Y60gW/D96K/Ins97aV, Q38H/I41S/D60bT/F60eS/Y60gW/D96K/Ins97aV/G151H, Q38H/I41S/D60bT/F60eS/Y60gW/D96K/F97G, Q38H/I41S/D60bT/F60eS/Y60gW/D96K/F97G/G151H, Q38H/I41S/D60bT/F60eS/Y60gW/D96K/F97G/Ins97aV, Q38H/I41S/D60bT/F60eS/Y60gW/D96K/F97G/Ins97aV/G151H, and the same modifications except C122S is not modified and is C122C.

10. The modified MTSP-1 polypeptide of claim 1, comprising modifications selected from among combinations of replacements that include one or more selected from among: Q38H, I41S, D60bT, F60eS, Y60gW, D96K, F97G, Ins97aV, and G151H, and include the replacements T98P/F99L/Q175L/Q192D, and optionally C122S, by chymotrypsin numbering, as follows: T98P/F99L/C122S/G151H/Q175L/Q192D, Ins97aV/T98P/F99L/C122S/Q175L/Q192D, Ins97aV/T98P/F99L/C122S/G151H/Q175L/Q192D, F97G/T98P/F99L/C122S/Q175L/Q192D, F97G/T98P/F99L/C122S/G151H/Q175L/Q192D, F97G/Ins97aV/T98P/F99L/C122S/Q175L/Q192D, F97G/Ins97aV/T98P/F99L/C122S/G151H/Q175L/Q192D, D96K/T98P/F99L/C122S/Q175L/Q192D, D96K/T98P/F99L/C122S/G151H/Q175L/Q192D, D96K/Ins97aV/T98P/F99L/C122S/Q175L/Q192D, D96K/Ins97aV/T98P/F99L/C122S/G151H/Q175L/Q192D, D96K/F97G/T98P/F99L/C122S/Q175L/Q192D, D96K/F97G/T98P/F99L/C122S/G151H/Q175L/Q192D, D96K/F97G/Ins97aV/T98P/F99L/C122S/Q175L/Q192D, D96K/F97G/Ins97aV/T98P/F99L/C122S/G151H/Q175L/Q192D, Y60gW/T98P/F99L/C122S/Q175L/Q192D, Y60gW/T98P/F99L/C122S/G151H/Q175L/Q192D, Y60gW/Ins97aV/T98P/F99L/C122S/Q175L/Q192D, Y60gW/Ins97aV/T98P/F99L/C122S/G151H/Q175L/Q192D, Y60gW/F97G/T98P/F99L/C122S/Q175L/Q192D, Y60gW/F97G/T98P/F99L/C122S/G151H/Q175L/Q192D, Y60gW/F97G/Ins97aV/T98P/F99L/C122S/Q175L/Q192D, Y60gW/F97G/Ins97aV/T98P/F99L/C122S/G151H/Q175L/Q192D, Y60gW/D96K/T98P/F99L/C122S/Q175L/Q192D, Y60gW/D96K/T98P/F99L/C122S/G151H/Q175L/Q192D, Y60gW/D96K/Ins97aV/T98P/F99L/C122S/Q175L/Q192D, Y60gW/D96K/Ins97aV/T98P/F99L/C122S/G151H/Q175L/Q192D, Y60gW/D96K/F97G/T98P/F99L/C122S/Q175L/Q192D, Y60gW/D96K/F97G/T98P/F99L/C122S/G151H/Q175L/Q192D, Y60gW/D96K/F97G/Ins97aV/T98P/F99L/C122S/Q175L/Q192D, Y60gW/D96K/F97G/Ins97aV/T98P/F99L/C122S/G151H/Q175L/Q192D, F60eS/T98P/F99L/C122S/Q175L/Q192D, F60eS/T98P/F99L/C122S/G151H/Q175L/Q192D, F60eS/Ins97aV/T98P/F99L/C122S/Q175L/Q192D, F60eS/Ins97aV/T98P/F99L/C122S/G151H/Q175L/Q192D, F60eS/F97G/T98P/F99L/C122S/Q175L/Q192D, F60eS/F97G/T98P/F99L/C122S/G151H/Q175L/Q192D, F60eS/F97G/Ins97aV/T98P/F99L/C122S/Q175L/Q192D, F60eS/F97G/Ins97aV/T98P/F99L/C122S/G151H/Q175L/Q192D, F60eS/D96K/T98P/F99L/C122S/Q175L/Q192D, F60eS/D96K/T98P/F99L/C122S/G151H/Q175L/Q192D, F60eS/D96K/Ins97aV/T98P/F99L/C122S/Q175L/Q192D, F60eS/D96K/Ins97aV/T98P/F99L/C122S/G151H/Q175L/Q192D, F60eS/D96K/F97G/T98P/F99L/C122S/Q175L/Q192D, F60eS/D96K/F97G/T98P/F99L/C122S/G151H/Q175L/Q192D, F60eS/D96K/F97G/Ins97aV/T98P/F99L/C122S/Q175L/Q192D, F60eS/D96K/F97G/Ins97aV/T98P/F99L/C122S/G151H/Q175L/Q192D, F60eS/Y60gW/T98P/F99L/C122S/Q175L/Q192D, F60eS/Y60gW/T98P/

F99L/C122S/G151H/Q175L/Q192D, F60eS/Y60gW/Ins97aV/T98P/F99L/C122S/Q175L/Q192D, F60eS/Y60gW/Ins97aV/T98P/F99L/C122S/G151H/Q175L/Q192D, F60eS/Y60gW/F97G/T98P/F99L/C122S/Q175L/Q192D, F60eS/Y60gW/F97G/T98P/F99L/C122S/G151H/Q175L/Q192D, F60eS/Y60gW/F97G/Ins97aV/T98P/F99L/C122S/Q175L/Q192D, F60eS/Y60gW/F97G/Ins97aV/T98P/F99L/C122S/G151H/Q175L/Q192D, F60eS/Y60gW/D96K/T98P/F99L/C122S/Q175L/Q192D, F60eS/Y60gW/D96K/T98P/F99L/C122S/G151H/Q175L/Q192D, F60eS/Y60gW/D96K/Ins97aV/T98P/F99L/C122S/Q175L/

C122S/Q175L/Q192D, I41S/F60eS/F97G/Ins97aV/T98P/F99L/C122S/G151H/Q175L/Q192D, I41S/F60eS/D96K/T98P/F99L/C122S/Q175L/Q192D, I41S/F60eS/D96K/T98P/F99L/C122S/G151H/Q175L/Q192D, I41S/F60eS/D96K/Ins97aV/T98P/F99L/C122S/Q 175L/Q192D, I41S/F60eS/D96K/Ins97aV/T98P/F99L/C122S/G151H/Q175L/Q192D, I41S/F60eS/D96K/F97G/T98P/F99L/C122S/Q175L/Q192D, I41S/F60eS/D96K/F97G/T98P/F99L/C122S/G151H/Q175L/Q192D, I41S/F60eS/D96K/F97G/Ins97aV/T98P/F99L/C122S/Q175L/Q192D, I41S/F60eS/D96K/F97G/Ins97aV/T98P/F99L/C122S/G151H/Q175L/Q192D, I41S/F60eS/Y60gW/T98P/F99L/C122S/Q175L/Q192D, I41S/F60eS/Y60gW/T98P/F99L/C122S/G151H/Q175L/Q192D, I41S/F60eS/Y60gW/Ins97aV/T98P/F99L/C122S/Q175L/Q192D, I41S/F60eS/Y60gW/Ins97aV/T98P/F99L/C122S/G151H/Q175L/Q192D, I41S/F60eS/Y60gW/F97G/T98P/F99L/C122S/Q175L/Q192D, I41S/F60eS/Y60gW/F97G/T98P/F99L/C122S/G151H/Q175L/Q192D, I41S/F60eS/Y60gW/F97G/Ins97aV/T98P/F99L/C122S/Q175L/Q192D, I41S/F60eS/Y60gW/F97G/Ins97aV/T98P/F99L/C122S/G151H/Q175L/Q192D, I41S/F60eS/Y60gW/D96K/T98P/F99L/C122S/Q175L/Q192D, I41S/F60eS/Y60gW/D96K/T98P/F99L/C122S/G151H/Q175L/Q192D, I41S/F60eS/Y60gW/D96K/Ins97aV/T98P/F99L/C122S/Q175L/Q192D, I41S/F60eS/Y60gW/D96K/Ins97aV/T98P/F99L/C122S/G151H/Q175L/Q192D, I41S/F60eS/Y60gW/D96K/F97G/T98P/F99L/C122S/Q175L/Q192D, I41S/F60eS/Y60gW/D96K/F97G/T98P/F99L/C122S/G151H/Q175L/Q192D, I41S/F60eS/Y60gW/D96K/F97G/Ins97aV/T98P/F99L/C122S/Q175L/Q192D, I41S/F60eS/Y60gW/D96K/F97G/Ins97aV/T98P/F99L/C122S/G151H/Q175L/Q192D, I41S/D60bT/T98P/F99L/C122S/Q175L/Q192D, I41S/D60bT/T98P/F99L/C122S/G151H/Q175L/Q192D, I41S/D60bT/Ins97aV/T98P/F99L/C122S/Q175L/Q192D, I41S/D60bT/Ins97aV/T98P/F99L/C122S/G151H/Q175L/Q192D, I41S/D60bT/F97G/T98P/F99L/C122S/Q175L/Q192D, I41S/D60bT/F97G/T98P/F99L/C122S/G151H/Q175L/Q192D, I41S/D60bT/F97G/Ins97aV/T98P/F99L/C122S/Q 175L/Q192D, I41S/D60bT/F97G/Ins97aV/T98P/F99L/C122S/G151H/Q175L/Q192D, I41S/D60bT/D96K/T98P/F99L/C122S/Q175L/Q192D, I41S/D60bT/D96K/T98P/F99L/C122S/G151H/Q175L/Q192D, I41S/D60bT/D96K/Ins97aV/T98P/F99L/C122S/Q 175L/Q192D, I41S/D60bT/D96K/Ins97aV/T98P/F99L/C122S/G151H/Q175L/Q192D, I41S/D60bT/D96K/F97G/T98P/F99L/C122S/Q175L/Q192D, I41S/D60bT/D96K/F97G/T98P/F99L/C122S/G151H/Q175L/Q192D, I41S/D60bT/D96K/F97G/Ins97aV/T98P/F99L/C122S/Q175L/Q192D, I41S/D60bT/D96K/F97G/Ins97aV/T98P/F99L/C122S/G151H/Q175L/Q192D, I41S/D60bT/Y60gW/T98P/F99L/C122S/Q175L/Q192D, I41S/D60bT/Y60gW/T98P/F99L/C122S/G151H/Q175L/Q192D, I41S/D60bT/Y60gW/Ins97aV/T98P/F99L/C122S/Q175L/Q192D, I41S/D60bT/Y60gW/Ins97aV/T98P/F99L/C122S/G151H/Q175L/Q192D, I41S/D60bT/Y60gW/F97G/T98P/F99L/C122S/Q175L/Q192D, I41S/D60bT/Y60gW/F97G/T98P/F99L/C122S/G151H/Q175L/Q192D, I41S/D60bT/Y60gW/F97G/Ins97aV/T98P/F99L/C122S/Q175L/Q192D, I41S/D60bT/Y60gW/F97G/Ins97aV/T98P/F99L/C122S/G151H/Q175L/Q192D, I41S/D60bT/Y60gW/D96K/T98P/F99L/C122S/Q175L/Q192D, I41S/D60bT/Y60gW/D96K/T98P/F99L/C122S/G151H/Q175L/Q192D, I41S/D60bT/Y60gW/D96K/Ins97aV/T98P/F99L/C122S/Q175L/Q192D, I41S/D60bT/Y60gW/D96K/Ins97aV/T98P/F99L/C122S/G151H/Q175L/Q192D, I41S/D60bT/Y60gW/D96K/F97G/T98P/F99L/C122S/Q175L/Q192D, I41S/D60bT/Y60gW/D96K/F97G/T98P/F99L/C122S/G151H/Q175L/Q192D, I41S/D60bT/Y60gW/D96K/F97G/Ins97aV/T98P/F99L/C122S/Q175L/Q192D, I41S/D60bT/Y60gW/D96K/F97G/Ins97aV/T98P/F99L/C122S/G151H/Q175L/Q192D, I41S/D60bT/F60eS/T98P/F99L/C122S/Q175L/Q192D, I41S/D60bT/F60eS/T98P/F99L/C122S/G151H/Q175L/Q192D, I41S/D60bT/F60eS/Ins97aV/T98P/F99L/C122S/Q175L/Q192D, I41S/D60bT/F60eS/Ins97aV/T98P/F99L/C122S/G151H/Q175L/Q192D, I41S/D60bT/F60eS/F97G/T98P/F99L/C122S/Q175L/Q192D, I41S/D60bT/F60eS/F97G/T98P/F99L/C122S/G151H/Q175L/Q192D, I41S/D60bT/F60eS/F97G/Ins97aV/T98P/F99L/C122S/Q175L/Q192D, I41S/D60bT/F60eS/F97G/Ins97aV/T98P/F99L/C122S/G151H/Q175L/Q192D, I41S/D60bT/F60eS/D96K/T98P/F99L/C122S/Q175L/Q192D, I41S/D60bT/F60eS/D96K/T98P/F99L/C122S/G151H/Q175L/Q192D, I41S/D60bT/F60eS/D96K/Ins97aV/T98P/F99L/C122S/Q175L/Q192D, I41S/D60bT/F60eS/D96K/Ins97aV/T98P/F99L/C122S/G151H/Q175L/Q192D, I41S/D60bT/F60eS/D96K/F97G/T98P/F99L/C122S/Q175L/Q192D, I41S/D60bT/F60eS/D96K/F97G/T98P/F99L/C122S/G151H/Q175L/Q192D, I41S/D60bT/F60eS/D96K/F97G/Ins97aV/T98P/F99L/C122S/Q175L/Q192D, I41S/D60bT/F60eS/D96K/F97G/Ins97aV/T98P/F99L/C122S/G151H/Q175L/Q192D, I41S/D60bT/F60eS/Y60gW/T98P/F99L/C122S/Q175L/Q192D, I41S/D60bT/F60eS/Y60gW/T98P/F99L/C122S/G151H/Q175L/Q192D, I41S/D60bT/F60eS/Y60gW/Ins97aV/T98P/F99L/C122S/Q175L/Q192D, I41S/D60bT/F60eS/Y60gW/Ins97aV/T98P/F99L/C122S/G151H/Q175L/Q192D, I41S/D60bT/F60eS/Y60gW/F97G/T98P/F99L/C122S/Q175L/Q192D, I41S/D60bT/F60eS/Y60gW/F97G/T98P/F99L/C122S/G151H/Q175L/Q192D, I41S/D60bT/F60eS/Y60gW/F97G/Ins97aV/T98P/F99L/C122S/Q175L/Q192D, I41S/D60bT/F60eS/Y60gW/F97G/Ins97aV/T98P/F99L/C122S/G151H/Q175L/Q192D, I41S/D60bT/F60eS/Y60gW/D96K/T98P/F99L/C122S/Q175L/Q192D, I41S/D60bT/F60eS/Y60gW/D96K/T98P/F99L/C122S/G151H/Q175L/Q192D, I41S/D60bT/F60eS/Y60gW/D96K/Ins97aV/T98P/F99L/C122S/Q175L/Q192D, I41S/D60bT/F60eS/Y60gW/D96K/Ins97aV/T98P/F99L/C122S/G151H/Q175L/Q192D, I41S/D60bT/F60eS/Y60gW/D96K/F97G/T98P/F99L/C122S/Q175L/Q192D, I41S/D60bT/F60eS/Y60gW/D96K/F97G/T98P/F99L/C122S/G151H/Q175L/Q192D, I41S/D60bT/F60eS/Y60gW/D96K/F97G/Ins97aV/T98P/F99L/C122S/Q175L/Q192D, I41S/D60bT/F60eS/Y60gW/D96K/F97G/Ins97aV/T98P/F99L/C122S/G151H/Q175L/Q192D, Q38H/T98P/F99L/C122S/Q175L/Q192D, Q38H/T98P/F99L/C122S/G151H/Q175L/Q192D, Q38H/Ins97aV/T98P/F99L/C122S/Q175L/Q192D, Q38H/Ins97aV/T98P/F99L/C122S/G151H/Q175L/Q192D, Q38H/F97G/T98P/F99L/C122S/Q175L/Q192D, Q38H/F97G/T98P/F99L/C122S/G151H/Q175L/Q192D, Q38H/F97G/Ins97aV/T98P/F99L/C122S/Q175L/Q192D, Q38H/F97G/Ins97aV/T98P/F99L/C122S/G151H/Q175L/Q192D, Q38H/D96K/T98P/F99L/C122S/Q175L/Q192D, Q38H/D96K/T98P/F99L/C122S/G151H/Q175L/Q192D, Q38H/D96K/Ins97aV/T98P/F99L/C122S/Q175L/Q192D, Q38H/D96K/Ins97aV/T98P/F99L/C122S/G151H/Q175L/Q192D, Q38H/D96K/F97G/T98P/F99L/C122S/Q175L/Q192D, Q38H/D96K/F97G/T98P/F99L/C122S/G151H/Q175L/Q192D, Q38H/D96K/F97G/Ins97aV/T98P/F99L/C122S/Q175L/Q192D, Q38H/D96K/F97G/Ins97aV/T98P/F99L/C122S/G151H/Q175L/Q192D, Q38H/Y60gW/T98P/F99L/C122S/Q175L/Q192D, Q38H/Y60gW/T98P/F99L/C122S/G151H/Q175L/Q192D, Q38H/Y60gW/Ins97aV/T98P/F99L/C122S/Q175L/Q192D, Q38H/Y60gW/Ins97aV/T98P/F99L/C122S/G151H/Q175L/Q192D, Q38H/Y60gW/F97G/T98P/F99L/C122S/Q175L/Q192D, Q38H/Y60gW/

F97G/T98P/F99L/C122S/G151H/Q175L/Q192D, Q38H/Y60gW/F97G/Ins97aV/T98P/F99L/C122S/Q175L/Q192D, Q38H/Y60gW/F97G/Ins97aV/T98P/F99L/C122S/G151H/Q175L/Q192D, Q38H/Y60gW/D96K/T98P/F99L/C122S/Q175L/Q192D, Q38H/Y60gW/D96K/T98P/F99L/C122S/G151H/Q175L/Q192D, Q38H/Y60gW/D96K/Ins97aV/T98P/F99L/C122S/Q175L/Q192D, Q38H/Y60gW/D96K/Ins97aV/T98P/F99L/C122S/G151H/Q175L/Q192D, Q38H/Y60gW/D96K/F97G/T98P/F99L/C122S/Q175L/Q192D, Q38H/Y60gW/D96K/F97G/T98P/F99L/C122S/G151H/Q175L/Q192D, Q38H/Y60gW/D96K/F97G/Ins97aV/T98P/F99L/C122S/Q175L/Q192D, Q38H/Y60gW/D96K/F97G/Ins97aV/T98P/F99L/C122S/G151H/Q175L/Q192D, Q38H/F60eS/T98P/F99L/C122S/Q175L/Q192D, Q38H/F60eS/T98P/F99L/C122S/G151H/Q175L/Q192D, Q38H/F60eS/Ins97aV/T98P/F99L/C122S/Q175L/Q192D, Q38H/F60eS/Ins97aV/T98P/F99L/C122S/G151H/Q175L/Q192D, Q38H/F60eS/F97G/T98P/F99L/C122S/Q175L/Q192D, Q38H/F60eS/F97G/T98P/F99L/C122S/G151H/Q175L/Q192D, Q38H/F60eS/F97G/Ins97aV/T98P/F99L/C122S/Q175L/Q192D, Q38H/F60eS/F97G/Ins97aV/T98P/F99L/C122S/G151H/Q175L/Q192D, Q38H/F60eS/D96K/T98P/F99L/C122S/Q175L/Q192D, Q38H/F60eS/D96K/T98P/F99L/C122S/G151H/Q175L/Q192D, Q38H/F60eS/D96K/Ins97aV/T98P/F99L/C122S/Q175L/Q192D, Q38H/F60eS/D96K/Ins97aV/T98P/F99L/C122S/G151H/Q175L/Q192D, Q38H/F60eS/D96K/F97G/T98P/F99L/C122S/Q175L/Q192D, Q38H/F60eS/D96K/F97G/T98P/F99L/C122S/G151H/Q175L/Q192D, Q38H/F60eS/D96K/F97G/Ins97aV/T98P/F99L/C122S/Q175L/Q192D, Q38H/F60eS/D96K/F97G/Ins97aV/T98P/F99L/C122S/G151H/Q175L/Q192D, Q38H/F60eS/Y60gW/T98P/F99L/C122S/Q175L/Q192D, Q38H/F60eS/Y60gW/T98P/F99L/C122S/G151H/Q175L/Q192D, Q38H/F60eS/Y60gW/Ins97aV/T98P/F99L/C122S/Q175L/Q192D, Q38H/F60eS/Y60gW/Ins97aV/T98P/F99L/C122S/G151H/Q175L/Q192D, Q38H/F60eS/Y60gW/F97G/T98P/F99L/C122S/Q175L/Q192D, Q38H/F60eS/Y60gW/F97G/T98P/F99L/C122S/G151H/Q175L/Q192D, Q38H/F60eS/Y60gW/F97G/Ins97aV/T98P/F99L/C122S/Q175L/Q192D, Q38H/F60eS/Y60gW/F97G/Ins97aV/T98P/F99L/C122S/G151H/Q175L/Q192D, Q38H/F60eS/Y60gW/D96K/T98P/F99L/C122S/Q175L/Q192D, Q38H/F60eS/Y60gW/D96K/T98P/F99L/C122S/G151H/Q175L/Q192D, Q38H/F60eS/Y60gW/D96K/Ins97aV/T98P/F99L/C122S/Q175L/Q192D, Q38H/F60eS/Y60gW/D96K/Ins97aV/T98P/F99L/C122S/G151H/Q175L/Q192D, Q38H/F60eS/Y60gW/D96K/F97G/T98P/F99L/C122S/Q175L/Q192D, Q38H/F60eS/Y60gW/D96K/F97G/T98P/F99L/C122S/G151H/Q175L/Q192D, Q38H/F60eS/Y60gW/D96K/F97G/Ins97aV/T98P/F99L/C122S/Q175L/Q192D, Q38H/F60eS/Y60gW/D96K/F97G/Ins97aV/T98P/F99L/C122S/G151H/Q175L/Q192D, Q38H/D60bT/T98P/F99L/C122S/Q175L/Q192D, Q38H/D60bT/T98P/F99L/C122S/G151H/Q175L/Q192D, Q38H/D60bT/Ins97aV/T98P/F99L/C122S/Q175L/Q192D, Q38H/D60bT/Ins97aV/T98P/F99L/C122S/G151H/Q175L/Q192D, Q38H/D60bT/F97G/T98P/F99L/C122S/Q175L/Q192D, Q38H/D60bT/F97G/T98P/F99L/C122S/G151H/Q175L/Q192D, Q38H/D60bT/F97G/Ins97aV/T98P/F99L/C122S/Q175L/Q192D, Q38H/D60bT/F97G/Ins97aV/T98P/F99L/C122S/G151H/Q175L/Q192D, Q38H/D60bT/D96K/T98P/F99L/C122S/Q175L/Q192D, Q38H/D60bT/D96K/T98P/F99L/C122S/G151H/Q175L/Q192D, Q38H/D60bT/D96K/Ins97aV/T98P/F99L/C122S/Q175L/Q192D, Q38H/D60bT/D96K/Ins97aV/T98P/F99L/C122S/G151H/Q175L/Q192D, Q38H/D60bT/D96K/F97G/T98P/F99L/C122S/Q175L/Q192D, Q38H/D60bT/D96K/F97G/T98P/F99L/C122S/G151H/Q175L/Q192D, Q38H/D60bT/D96K/F97G/Ins97aV/T98P/F99L/C122S/Q175L/Q192D, Q38H/D60bT/D96K/F97G/Ins97aV/T98P/F99L/C122S/G151H/Q175L/Q192D, Q38H/D60bT/Y60gW/T98P/F99L/C122S/Q175L/Q192D, Q38H/D60bT/Y60gW/T98P/F99L/C122S/G151H/Q175L/Q192D, Q38H/D60bT/Y60gW/Ins97aV/T98P/F99L/C122S/Q175L/Q192D, Q38H/D60bT/Y60gW/Ins97aV/T98P/F99L/C122S/G151H/Q175L/Q192D, Q38H/D60bT/Y60gW/F97G/T98P/F99L/C122S/Q175L/Q192D, Q38H/D60bT/Y60gW/F97G/T98P/F99L/C122S/G151H/Q175L/Q192D, Q38H/D60bT/Y60gW/F97G/Ins97aV/T98P/F99L/C122S/Q175L/Q192D, Q38H/D60bT/Y60gW/F97G/Ins97aV/T98P/F99L/C122S/G151H/Q175L/Q192D, Q38H/D60bT/Y60gW/D96K/T98P/F99L/C122S/Q175L/Q192D, Q38H/D60bT/Y60gW/D96K/T98P/F99L/C122S/G151H/Q175L/Q192D, Q38H/D60bT/Y60gW/D96K/Ins97aV/T98P/F99L/C122S/Q175L/Q192D, Q38H/D60bT/Y60gW/D96K/Ins97aV/T98P/F99L/C122S/G151H/Q175L/Q192D, Q38H/D60bT/Y60gW/D96K/F97G/T98P/F99L/C122S/Q175L/Q192D, Q38H/D60bT/Y60gW/D96K/F97G/T98P/F99L/C122S/G151H/Q175L/Q192D, Q38H/D60bT/Y60gW/D96K/F97G/Ins97aV/T98P/F99L/C122S/Q175L/Q192D, Q38H/D60bT/Y60gW/D96K/F97G/Ins97aV/T98P/F99L/C122S/G151H/Q175L/Q192D, Q38H/D60bT/F60eS/T98P/F99L/C122S/Q175L/Q192D, Q38H/D60bT/F60eS/T98P/F99L/C122S/G151H/Q175L/Q192D, Q38H/D60bT/F60eS/Ins97aV/T98P/F99L/C122S/Q175L/Q192D, Q38H/D60bT/F60eS/Ins97aV/T98P/F99L/C122S/G151H/Q175L/Q192D, Q38H/D60bT/F60eS/F97G/T98P/F99L/C122S/Q175L/Q192D, Q38H/D60bT/F60eS/F97G/T98P/F99L/C122S/G151H/Q175L/Q192D, Q38H/D60bT/F60eS/F97G/Ins97aV/T98P/F99L/C122S/Q175L/Q192D, Q38H/D60bT/F60eS/F97G/Ins97aV/T98P/F99L/C122S/G151H/Q175L/Q192D, Q38H/D60bT/F60eS/D96K/T98P/F99L/C122S/Q175L/Q192D, Q38H/D60bT/F60eS/D96K/T98P/F99L/C122S/G151H/Q175L/Q192D, Q38H/D60bT/F60eS/D96K/Ins97aV/T98P/F99L/C122S/Q175L/Q192D, Q38H/D60bT/F60eS/D96K/Ins97aV/T98P/F99L/C122S/G151H/Q175L/Q192D, Q38H/D60bT/F60eS/D96K/F97G/T98P/F99L/C122S/Q175L/Q192D, Q38H/D60bT/F60eS/D96K/F97G/T98P/F99L/C122S/G151H/Q175L/Q192D, Q38H/D60bT/F60eS/D96K/F97G/Ins97aV/T98P/F99L/C122S/Q175L/Q192D, Q38H/D60bT/F60eS/D96K/F97G/Ins97aV/T98P/F99L/C122S/G151H/Q175L/Q192D, Q38H/D60bT/F60eS/Y60gW/T98P/F99L/C122S/Q175L/Q192D, Q38H/D60bT/F60eS/Y60gW/T98P/F99L/C122S/G151H/Q175L/Q192D, Q38H/D60bT/F60eS/Y60gW/Ins97aV/T98P/F99L/C122S/Q175L/Q192D, Q38H/D60bT/F60eS/Y60gW/Ins97aV/T98P/F99L/C122S/G151H/Q175L/Q192D, Q38H/D60bT/F60eS/Y60gW/F97G/T98P/F99L/C122S/Q 175L/Q192D, Q38H/D60bT/F60eS/Y60gW/F97G/T98P/F99L/C122S/G151H/Q175L/Q192D, Q38H/D60bT/F60eS/Y60gW/F97G/Ins97aV/T98P/F99L/C122S/Q175L/Q192D, Q38H/D60bT/F60eS/Y60gW/F97G/Ins97aV/T98P/F99L/C122S/G151H/Q175L/Q192D, Q38H/D60bT/F60eS/Y60gW/D96K/T98P/F99L/C122S/Q175L/Q192D, Q38H/D60bT/F60eS/Y60gW/D96K/T98P/F99L/C122S/G151H/Q175L/Q192D, Q38H/D60bT/F60eS/Y60gW/D96K/Ins97aV/T98P/F99L/C122S/Q 175L/Q192D, Q38H/D60bT/F60eS/Y60gW/D96K/Ins97aV/T98P/F99L/C122S/G151H/Q175L/Q192D, Q38H/D60bT/F60eS/Y60gW/D96K/F97G/T98P/F99L/C122S/Q175L/Q192D, Q38H/D60bT/F60eS/Y60gW/D96K/F97G/T98P/F99L/C122S/G151H/Q175L/Q192D, Q38H/D60bT/F60eS/Y60gW/D96K/F97G/Ins97aV/T98P/F99L/C122S/Q175L/Q192D, Q38H/D60bT/F60eS/Y60gW/D96K/F97G/Ins97aV/T98P/F99L/C122S/

G151H/Q 175L/Q192D, Q38H/I41S/T98P/F99L/C122S/Q175L/Q192D, Q38H/I41S/T98P/F99L/C122S/G151H/Q175L/Q192D, Q38H/I41S/Ins97aV/T98P/F99L/C122S/Q175L/Q192D, Q38H/I41S/Ins97aV/T98P/F99L/C122S/G151H/Q175L/Q192D, Q38H/I41S/F97G/T98P/F99L/C122S/Q175L/Q192D, Q38H/I41S/F97G/T98P/F99L/C122S/G151H/Q175L/Q192D, Q38H/I41S/F97G/Ins97aV/T98P/F99L/C122S/Q175L/Q192D, Q38H/I41S/F97G/Ins97aV/T98P/F99L/C122S/G151H/Q175L/Q192D, Q38H/I41S/D96K/T98P/F99L/C122S/Q175L/Q192D, Q38H/I41S/D96K/T98P/F99L/C122S/G151H/Q175L/Q192D, Q38H/I41S/D96K/Ins97aV/T98P/F99L/C122S/Q175L/Q192D, Q38H/I41S/D96K/Ins97aV/T98P/F99L/C122S/G151H/Q175L/Q192D, Q38H/I41S/D96K/F97G/T98P/F99L/C122S/Q175L/Q192D, Q38H/I41S/D96K/F97G/T98P/F99L/C122S/G151H/Q175L/Q192D, Q38H/I41S/D96K/F97G/Ins97aV/T98P/F99L/C122S/Q175L/Q192D, Q38H/I41S/D96K/F97G/Ins97aV/T98P/F99L/C122S/G151H/Q175L/Q192D, Q38H/I41S/Y60gW/T98P/F99L/C122S/Q175L/Q192D, Q38H/I41S/Y60gW/T98P/F99L/C122S/G151H/Q175L/Q192D, Q38H/I41S/Y60gW/Ins97aV/T98P/F99L/C122S/Q175L/Q192D, Q38H/I41S/Y60gW/Ins97aV/T98P/F99L/C122S/G151H/Q175L/Q192D, Q38H/I41S/Y60gW/F97G/T98P/F99L/C122S/Q175L/Q192D, Q38H/I41S/Y60gW/F97G/T98P/F99L/C122S/G151H/Q175L/Q192D, Q38H/I41S/Y60gW/F97G/Ins97aV/T98P/F99L/C122S/Q175L/Q192D, Q38H/I41S/Y60gW/F97G/Ins97aV/T98P/F99L/C122S/G151H/Q175L/Q192D, Q38H/I41S/Y60gW/D96K/T98P/F99L/C122S/Q175L/Q192D, Q38H/I41S/Y60gW/D96K/T98P/F99L/C122S/G151H/Q175L/Q192D, Q38H/I41S/Y60gW/D96K/Ins97aV/T98P/F99L/C122S/Q175L/Q192D, Q38H/I41S/Y60gW/D96K/Ins97aV/T98P/F99L/C122S/G151H/Q175L/Q192D, Q38H/I41S/Y60gW/D96K/F97G/T98P/F99L/C122S/Q175L/Q192D, Q38H/I41S/Y60gW/D96K/F97G/T98P/F99L/C122S/G151H/Q175L/Q192D, Q38H/I41S/Y60gW/D96K/F97G/Ins97aV/T98P/F99L/C122S/Q175L/Q192D, Q38H/I41S/Y60gW/D96K/F97G/Ins97aV/T98P/F99L/C122S/G151H/Q175L/Q192D, Q38H/I41S/F60eS/T98P/F99L/C122S/Q175L/Q192D, Q38H/I41S/F60eS/T98P/F99L/C122S/G151H/Q175L/Q192D, Q38H/I41S/F60eS/Ins97aV/T98P/F99L/C122S/Q 175L/Q192D, Q38H/I41S/F60eS/Ins97aV/T98P/F99L/C122S/G151H/Q175L/Q192D, Q38H/I41S/F60eS/F97G/T98P/F99L/C122S/Q175L/Q192D, Q38H/I41S/F60eS/F97G/T98P/F99L/C122S/G151H/Q175L/Q192D, Q38H/I41S/F60eS/F97G/Ins97aV/T98P/F99L/C122S/Q175L/Q192D, Q38H/I41S/F60eS/F97G/Ins97aV/T98P/F99L/C122S/G151H/Q175L/Q192D, Q38H/I41S/F60eS/D96K/T98P/F99L/C122S/Q175L/Q192D, Q38H/I41S/F60eS/D96K/T98P/F99L/C122S/G151H/Q175L/Q192D, Q38H/I41S/F60eS/D96K/Ins97aV/T98P/F99L/C122S/Q175L/Q192D, Q38H/I41S/F60eS/D96K/Ins97aV/T98P/F99L/C122S/G151H/Q175L/Q192D, Q38H/I41S/F60eS/D96K/F97G/T98P/F99L/C122S/Q175L/Q192D, Q38H/I41S/F60eS/D96K/F97G/T98P/F99L/C122S/G151H/Q175L/Q192D, Q38H/I41S/F60eS/D96K/F97G/Ins97aV/T98P/F99L/C122S/Q175L/Q192D, Q38H/I41S/F60eS/D96K/F97G/Ins97aV/T98P/F99L/C122S/G151H/Q175L/Q192D, Q38H/I41S/F60eS/Y60gW/T98P/F99L/C122S/Q175L/Q192D, Q38H/I41S/F60eS/Y60gW/T98P/F99L/C122S/G151H/Q175L/Q192D, Q38H/I41S/F60eS/Y60gW/Ins97aV/T98P/F99L/C122S/Q175L/Q192D, Q38H/I41S/F60eS/Y60gW/Ins97aV/T98P/F99L/C122S/G151H/Q175L/Q192D, Q38H/I41S/F60eS/Y60gW/F97G/T98P/F99L/C122S/Q175L/Q192D, Q38H/I41S/F60eS/Y60gW/F97G/T98P/F99L/C122S/G151H/Q175L/Q192D, Q38H/I41S/F60eS/Y60gW/F97G/Ins97aV/T98P/F99L/C122S/Q175L/Q192D, Q38H/I41S/F60eS/Y60gW/F97G/Ins97aV/T98P/F99L/C122S/G151H/Q175L/Q192D, Q38H/I41S/F60eS/Y60gW/D96K/T98P/F99L/C122S/Q175L/Q192D, Q38H/I41S/F60eS/Y60gW/D96K/T98P/F99L/C122S/G151H/Q175L/Q192D, Q38H/I41S/F60eS/Y60gW/D96K/Ins97aV/T98P/F99L/C122S/Q175L/Q192D, Q38H/I41S/F60eS/Y60gW/D96K/Ins97aV/T98P/F99L/C122S/G151H/Q175L/Q192D, Q38H/I41S/F60eS/Y60gW/D96K/F97G/T98P/F99L/C122S/Q175L/Q192D, Q38H/I41S/F60eS/Y60gW/D96K/F97G/T98P/F99L/C122S/G151H/Q175L/Q192D, Q38H/I41S/F60eS/Y60gW/D96K/F97G/Ins97aV/T98P/F99L/C122S/Q175L/Q192D, Q38H/I41S/F60eS/Y60gW/D96K/F97G/Ins97aV/T98P/F99L/C122S/G151H/Q175L/Q192D, Q38H/I41S/D60bT/T98P/F99L/C122S/Q175L/Q192D, Q38H/I41S/D60bT/T98P/F99L/C122S/G151H/Q175L/Q192D, Q38H/I41S/D60bT/Ins97aV/T98P/F99L/C122S/Q175L/Q192D, Q38H/I41S/D60bT/Ins97aV/T98P/F99L/C122S/G151H/Q175L/Q192D, Q38H/I41S/D60bT/F97G/T98P/F99L/C122S/Q175L/Q192D, Q38H/I41S/D60bT/F97G/T98P/F99L/C122S/G151H/Q175L/Q192D, Q38H/I41S/D60bT/F97G/Ins97aV/T98P/F99L/C122S/Q175L/Q192D, Q38H/I41S/D60bT/F97G/Ins97aV/T98P/F99L/C122S/G151H/Q175L/Q192D, Q38H/I41S/D60bT/D96K/T98P/F99L/C122S/Q175L/Q192D, Q38H/I41S/D60bT/D96K/T98P/F99L/C122S/G151H/Q175L/Q192D, Q38H/I41S/D60bT/D96K/Ins97aV/T98P/F99L/C122S/Q175L/Q192D, Q38H/I41S/D60bT/D96K/Ins97aV/T98P/F99L/C122S/G151H/Q175L/Q192D, Q38H/I41S/D60bT/D96K/F97G/T98P/F99L/C122S/Q175L/Q192D, Q38H/I41S/D60bT/D96K/F97G/T98P/F99L/C122S/G151H/Q175L/Q192D, Q38H/I41S/D60bT/D96K/F97G/Ins97aV/T98P/F99L/C122S/Q175L/Q192D, Q38H/I41S/D60bT/D96K/F97G/Ins97aV/T98P/F99L/C122S/G151H/Q175L/Q192D, Q38H/I41S/D60bT/Y60gW/T98P/F99L/C122S/Q175L/Q192D, Q38H/I41S/D60bT/Y60gW/T98P/F99L/C122S/G151H/Q175L/Q192D, Q38H/I41S/D60bT/Y60gW/Ins97aV/T98P/F99L/C122S/Q175L/Q192D, Q38H/I41S/D60bT/Y60gW/Ins97aV/T98P/F99L/C122S/G151H/Q175L/Q192D, Q38H/I41S/D60bT/Y60gW/F97G/T98P/F99L/C122S/Q175L/Q192D, Q38H/I41S/D60bT/Y60gW/F97G/T98P/F99L/C122S/G151H/Q175L/Q192D, Q38H/I41S/D60bT/Y60gW/F97G/Ins97aV/T98P/F99L/C122S/Q175L/Q192D, Q38H/I41S/D60bT/Y60gW/F97G/Ins97aV/T98P/F99L/C122S/G151H/Q175L/Q192D, Q38H/I41S/D60bT/Y60gW/D96K/T98P/F99L/C122S/Q175L/Q192D, Q38H/I41S/D60bT/Y60gW/D96K/T98P/F99L/C122S/G151H/Q175L/Q192D, Q38H/I41S/D60bT/Y60gW/D96K/Ins97aV/T98P/F99L/C122S/Q175L/Q192D, Q38H/I41S/D60bT/Y60gW/D96K/Ins97aV/T98P/F99L/C122S/G151H/Q175L/Q192D, Q38H/I41S/D60bT/Y60gW/D96K/F97G/T98P/F99L/C122S/Q175L/Q192D, Q38H/I41S/D60bT/Y60gW/D96K/F97G/T98P/F99L/C122S/G151H/Q175L/Q192D, Q38H/I41S/D60bT/Y60gW/D96K/F97G/Ins97aV/T98P/F99L/C122S/Q175L/Q192D, Q38H/I41S/D60bT/Y60gW/D96K/F97G/Ins97aV/T98P/F99L/C122S/G151H/Q175L/Q192D, Q38H/I41S/D60bT/F60eS/T98P/F99L/C122S/Q175L/Q192D, Q38H/I41S/D60bT/F60eS/T98P/F99L/C122S/G151H/Q175L/Q192D, Q38H/I41S/D60bT/F60eS/Ins97aV/T98P/F99L/C122S/Q175L/Q192D, Q38H/I41S/D60bT/F60eS/Ins97aV/T98P/F99L/C122S/G151H/Q175L/Q192D, Q38H/I41S/D60bT/F60eS/F97G/T98P/F99L/C122S/Q175L/Q192D, Q38H/I41S/D60bT/F60eS/F97G/T98P/F99L/C122S/G151H/Q175L/Q192D, Q38H/I41S/D60bT/F60eS/F97G/Ins97aV/T98P/F99L/C122S/Q175L/Q192D, Q38H/I41S/D60bT/F60eS/F97G/Ins97aV/T98P/F99L/

C122S/G151H/Q175L/Q192D, Q38H/I41S/D60bT/F60eS/ D96K/T98P/F99L/C122S/Q175L/Q192D, Q38H/I41S/ D60bT/F60eS/D96K/T98P/F99L/C122S/G151H/Q175L/ Q192D, Q38H/I41S/D60bT/F60eS/D96K/Ins97aV/T98P/ F99L/C122S/Q175L/Q192D, Q38H/I41S/D60bT/F60eS/ D96K/Ins97aV/T98P/F99L/C122S/G151H/Q175L/Q192D, Q38H/I41S/D60bT/F60eS/D96K/F97G/T98P/F99L/C122S/ Q175L/Q192D, Q38H/I41S/D60bT/F60eS/D96K/F97G/ T98P/F99L/C122S/G151H/Q175L/Q192D, Q38H/I41S/ D60bT/F60eS/D96K/F97G/Ins97aV/T98P/F99L/C122S/ Q175L/Q192D, Q38H/I41S/D60bT/F60eS/D96K/F97G/ Ins97aV/T98P/F99L/C122S/G151H/Q175L/Q192D, Q38H/I41S/D60bT/F60eS/Y60gW/T98P/F99L/C122S/ Q175L/Q192D, Q38H/I41S/D60bT/F60eS/Y60gW/T98P/ F99L/C122S/G151H/Q175L/Q192D, Q38H/I41S/D60bT/ F60eS/Y60gW/Ins97aV/T98P/F99L/C122S/Q175L/ Q192D, Q38H/I41S/D60bT/F60eS/Y60gW/Ins97aV/T98P/ F99L/C122S/G151H/Q175L/Q192D, Q38H/I41S/D60bT/ F60eS/Y60gW/F97G/T98P/F99L/C122S/Q175L/Q192D, Q38H/I41S/D60bT/F60eS/Y60gW/F97G/T98P/F99L/ C122S/G151H/Q175L/Q192D, Q38H/I41S/D60bT/F60eS/ Y60gW/F97G/Ins97aV/T98P/F99L/C122S/Q175L/Q192D, Q38H/I41S/D60bT/F60eS/Y60gW/F97G/Ins97aV/T98P/ F99L/C122S/G151H/Q175L/Q192 D, Q38H/I41S/D60bT/ F60eS/Y60gW/D96K/T98P/F99L/C122S/Q175L/Q192D, Q38H/I41S/D60bT/F60eS/Y60gW/D96K/T98P/F99L/ C122S/G151H/Q175L/Q192D, Q38H/I41S/D60bT/F60eS/ Y60gW/D96K/Ins97aV/T98P/F99L/C122S/Q175L/ Q192D, Q38H/I41S/D60bT/F60eS/Y60gW/D96K/ Ins97aV/T98P/F99L/C122S/G151H/Q175L/Q192D, Q38H/I41S/D60bT/F60eS/Y60gW/D96K/F97G/T98P/ F99L/C122S/Q175L/Q192D, Q38H/I41S/D60bT/F60eS/ Y60gW/D96K/F97G/T98P/F99L/C122S/G151H/Q175L/ Q192D, Q38H/I41S/D60bT/F60eS/Y60gW/D96K/F97G/ Ins97aV/T98P/F99L/C122S/Q175L/Q192D, Q38H/I41S/ D60bT/F60eS/Y60gW/D96K/F97G/Ins97aV/T98P/F99L/ C122S/G151H/Q175L/Q192D, and the same modifications except C122S is not modified and is C122C.

11. The modified MTSP-1 polypeptide of claim 1, comprising modifications corresponding to: Q38H/I41S/D60bT/ F60eS/Y60gW/D96K/F97G/ins97aV/T98P/F99L/C122S/ G151H/Q175L/Q192D or Q38H/I41S/D60bT/F60eS/ Y60gW/D96K/F97G/ins97aV/T98P/F99L/G151H/Q175L/ Q192D, by chymotrypsin numbering, wherein the unmodified MTSP-1 polypeptide comprises the protease domain of SEQ ID NO:2 or SEQ ID NO:4.

12. The modified MTSP-1 polypeptide of claim 1, wherein the modified MTSP-1 polypeptide comprises the sequence of amino acid residues set forth in any of SEQ ID NOs: 22-40, 43, 47-59, and 63-76.

13. The modified MTSP-1 polypeptide of claim 1, wherein the modified MTSP-1 polypeptide comprises the sequence of amino acid residues set forth in SEQ ID NO:35.

14. The modified MTSP-1 polypeptide of claim 1, wherein the unmodified MTSP-1 polypeptide consists of the sequence of amino acid residues set forth in SEQ ID NO:2 or 4.

15. The modified MTSP-1 polypeptide of claim 1 that is modified by a polymer to increase serum half-life or to reduce immunogenicity or both.

16. The modified MTSP-1 polypeptide of claim 15 that is PEGylated.

17. The modified MTSP-1 polypeptide of claim 13 that is PEGylated.

18. The modified MTSP-1 polypeptide of claim 1, wherein the modified MTSP-1 polypeptide comprises the sequence of amino acid residues set forth in SEQ ID NO:35, except that the residue at position 122, by chymotrypsin numbering is cysteine (C).

19. The modified MTSP-1 polypeptide of claim 18 that is pegylated.

20. The modified MTSP-1 polypeptide of claim 1, wherein the percentage of sequence identity to SEQ ID NO: 1, 2, 3, or 4 is at least 85%.

21. The modified MTSP-1 polypeptide of claim 1, wherein the percentage of sequence identity to SEQ ID NO: 1, 2, 3, or 4 is at least 90%.

22. The modified MTSP-1 polypeptide of claim 1, wherein the percentage of sequence identity to SEQ ID NO: 1, 2, 3, or 4 is at least 94%.

23. A fusion protein, comprising the modified MTSP-1 polypeptide of claim 1 that is linked to a multimerization domain or a protein transduction domain (PTD).

24. The fusion protein of claim 23, wherein the polypeptide is linked to a multimerization domain that is an Fc domain.

25. A method of treating a disease or condition mediated by or involving complement activation, comprising administering the modified MTSP-1 polypeptide of claim 1, wherein inhibition of complement activation effects treatment or amelioration of the disease or condition.

26. The method of claim 25, wherein the complement-mediated disease or condition is selected from among sepsis, Rheumatoid arthritis (RA), an ocular disease, membranoproliferative glomerulonephritis (MPGN), Multiple Sclerosis (MS), Myasthenia gravis (MG), asthma, inflammatory bowel disease, immune complex (IC)-mediated acute inflammatory tissue injury, Alzheimer's Disease (AD), and Ischemia-reperfusion injury.

27. The method of claim 25, wherein the disease or condition is an ocular disease or is rejection or inflammation due to a transplanted organ.

28. The method of claim 27, wherein the disease or condition is a diabetic retinopathy or a macular degeneration.

29. The method of claim 28, wherein the disease or condition is a macular degeneration.

30. The method of claim 29, wherein the macular degeneration is age-related macular degeneration (AMD).

31. The method of claim 27, wherein the disease or condition is delayed renal graft function (DGF).

32. The method of claim 25, wherein the modified MTSP-1 polypeptide is PEGylated.

33. A method of treating DGF, comprising intravenously administering the modified MTSP-1 polypeptide of claim 1.

34. The method of claim 30, wherein the modified MTSP-1 polypeptide comprises the sequence of amino acid residues set forth in SEQ ID NO:35.

35. The method of claim 30, wherein the modified MTSP-1 polypeptide comprises the modifications Q38H/ I41S/D60bT/F60eS/Y60gW/D96K/F97G/ins97aV/T98P/ F99L/C122S/G151H/Q175L/Q192D, by chymotrypsin numbering.

36. A method of treating an ophthalmic disorder or ocular disorder, comprising administering the modified MTSP-1 polypeptide of claim 1 to the eye.

37. The method of claim 36, wherein the disorder is macular degeneration or diabetic retinopathy.

38. The method of claim 37, wherein the disorder is age-related macular degeneration (AMD).

* * * * *

UNITED STATES PATENT AND TRADEMARK OFFICE
CERTIFICATE OF CORRECTION

PATENT NO. : 10,781,435 B2
APPLICATION NO. : 16/015093
DATED : September 22, 2020
INVENTOR(S) : Madison et al.

It is certified that error appears in the above-identified patent and that said Letters Patent is hereby corrected as shown below:

On the Title Page

In Item (56) References Cited, in OTHER PUBLICATIONS, at page 4, 1st Column, Line 35, please replace "Complement Blockade Prevents Delayed Graft Function Model of Kidney Allo-Transplantation" with —Complement Blockade Prevents Delayed Graft Function in a Non-Human Primate Model of Kidney Allo-Transplantation—;

In Item (56) References Cited, in OTHER PUBLICATIONS, at page 6, 1st Column, Line 52, please replace "1301-1311" with —1301-1311 (2001)—;

In Item (56) References Cited, in OTHER PUBLICATIONS, at page 6, 1st Column, Line 66, please replace "1681-1689" with —1681-1689 (1994)—;

In Item (56) References Cited, in OTHER PUBLICATIONS, at page 6, 2nd Column, Line 49, please replace "Macromere" with —Macromers—;

In the Specification

At Column 62, Line 40, please replace "Si" with —S1—;

At Column 63, Line 24, please replace "M2851, R381S, H656A, D711A, and 5805A" with —M285I, R381S, H656A, D711A, and S805A—;

At Column 63, Line 35, please replace "Si" with —S1—;

At Column 63, Line 38, please replace "Si" with —S1—;

At Column 63, Line 38, please replace "P sheets" with —β sheets—;

At Column 68, Line 56, please replace "Antive enzyme" with —Active enzyme—;

Signed and Sealed this
Sixth Day of September, 2022

Katherine Kelly Vidal
*Director of the United States Patent and Trademark Office*

CERTIFICATE OF CORRECTION (continued)
U.S. Pat. No. 10,781,435 B2

At Column 82, Table 12a, SEQ ID NO: 32, please replace "D961" with —D96I—;

At Column 83, Table 12a, SEQ ID NO: 76, please replace "D217V" with —I217V—;

At Column 83, Table 12a, SEQ ID NO: 80, please replace "F971" with —F97I—;

At Column 85, Table 12a, SEQ ID NO: 165, please replace "D2171" with —D217I—;

At Column 85, Table 12a, SEQ ID NO: 168, please replace "D2171" with —D217I—;

At Column 85, Table 12a, SEQ ID NO: 173, please replace "D2171" with —D217I—;

At Column 85, Table 12a, SEQ ID NO: 177, please replace "D2171" with —D217I—;

At column 85, Table 12a, SEQ ID NO: 183, please replace "D2171" with —D217I—;

At Column 85, Table 12a, SEQ ID NO: 212, please replace "D2171" with —D217I—;

At Column 85, Table 12a, SEQ ID NO: 215, please replace "D2171" with —D217I—;

At Column 85, Table 12a, SEQ ID NO: 233, please replace "Q1751" with —Q175I—;

At Column 87, Table 12a, SEQ ID NO: 251, please replace "Q1751" with —Q175I—;

At Column 87, Table 12a, SEQ ID NO: 252, please replace "Q1751" with —Q175I—;

At Column 87, Table 12a, SEQ ID NO: 253, please replace "Q1751" with —Q175I—;

At Column 87, Table 12a, SEQ ID NO: 262, please replace "1136M" with —I136M—;

At Column 87, Table 12a, SEQ ID NO: 265, please replace "V2121" with —V212I—;

At Column 87, Table 12a, SEQ ID NO: 268, please replace "V2121" with —V212I—;

At Column 87, Table 12a, SEQ ID NO: 291, please replace "F60e1" with —F60eI—;

At Column 87, Table 12a, SEQ ID NO: 292, please replace "Q1921" with —Q192I—;

At Column 87, Table 12a, SEQ ID NO: 302, please replace "F60e1" with —F60eI—;

At Column 87, Table 12a, SEQ ID NO: 303, please replace "F60e1" with —F60eI—;

At Column 87, Table 12a, SEQ ID NO: 304, please replace "Q1921" with —Q192I—;

At Column 89, Table 12a, SEQ ID NO: 333, please replace "F60e1" with —F60eI—;

CERTIFICATE OF CORRECTION (continued)
U.S. Pat. No. 10,781,435 B2

At Column 89, Table 12a, SEQ ID NO: 340, please replace "F60e1" with —F60eI—;

At Column 89, Table 12a, SEQ ID NO: 380, please replace "F60e1" with —F60eI—;

At Column 91, Table 12a, SEQ ID NO: 382, please replace "1136" with —I136L—;

At Column 91, Table 12a, SEQ ID NO: 385, please replace "D2171" with —D217I—;

At Column 91, Table 12a, SEQ ID NO: 386, please replace "D2171" with —D217I—;

At Column 91, Table 12a, SEQ ID NO: 387, please replace "1136V" with —I136V—;

At Column 91, Table 12a, SEQ ID NO: 387, please replace "1136M" with —I136M—;

At Column 91, Table 12a, SEQ ID NO: 390, please replace "1136V" with —I136V—;

At Column 91, Table 12a, SEQ ID NO: 391, please replace "1136V" with— I136F—;

At Column 91, Table 12a, SEQ ID NO: 392, please replace "1136V" with —I136F—;

At Column 91, Table 12a, SEQ ID NO: 394, please replace "1136V" with —I136T—;

At Column 91, Table 12a, SEQ ID NO: 395, please replace "1136V" with —I136V—;

At Column 91, Table 12a, SEQ ID NO: 403, please replace "1136F" with —I136F—;

At Column 91, Table 12a, SEQ ID NO: 404, please replace "1136L" with —I136L—;

At Column 91, Table 12a, SEQ ID NO: 405, please replace "1136V" with —I136V—;

At Column 91, Table 12a, SEQ ID NO: 407, please replace "1136M" with —I13M—;

At Column 91, Table 12a, SEQ ID NO: 408, please replace "D961" with —D96I—;

At Column 91, Table 12a, SEQ ID NO: 410, please replace "D961" with —D96I—;

At Column 91, Table 12a, SEQ ID NO: 411, please replace "in97a1" with —ins97aI—;

At Column 93, Table 12a, SEQ ID NO: 428, please replace "D961" with —D96I—;

At Column 93, Table 12a, SEQ ID NO: 429, please replace "D961" with —D96I—;

At Column 93, Table 12a, SEQ ID NO: 436, please replace "D961" with —D96I—;

At Column 95, Table 12a, SEQ ID NO: 505, please replace "Q1751" with —Q175I—;

CERTIFICATE OF CORRECTION (continued)
U.S. Pat. No. 10,781,435 B2

At Column 95, Table 12a, SEQ ID NO: 506, please replace "Q175I" with —Q175I—;

At Column 95, Table 12a, SEQ ID NO: 507, please replace "Q175I" with —Q175I—;

At Column 95, Table 12a, SEQ ID NO: 508, please replace "Q175I" with —Q175I—;

At Column 95, Table 12a, SEQ ID NO: 510, please replace "Q175I" with —Q175I—;

At Column 95, Table 12a, SEQ ID NO: 524, please replace "Q175I" with —Q175I—;

At Column 95, Table 12a, SEQ ID NO: 526, please replace "Q175I" with —Q175I—;

At Column 97, Table 12a, SEQ ID NO: 550, please replace "D217I" with —D217I—;

At Column 97, Table 12a, SEQ ID NO: 555, please replace "F97R/ins97a1/T98P/C122S/Q175M/Q192V/D217I" with —F97R/ins97aI/T98P/C122S/Q175M/Q192V/D217I—;

At Column 97, Table 12a, SEQ ID NO: 555, please replace "D217I" with —D217I—;

At Column 97, Table 12a, SEQ ID NO: 599, please replace "Q192TN213A" with —Q192T/V213A—;

At Column 99, Table 12a, SEQ ID NO: 607, please replace "1136M" with —I136M—;

At Column 99, Table 12a, SEQ ID NO: 621, please replace "Q192S" with —Q192S—;

At Column 99, Table 12a, SEQ ID NO: 623, please replace "Q192S" with —Q192S—;

At Column 99, Table 12a, SEQ ID NO: 633, please replace "D96I" with —D96I—;

At Column 99, Table 12a, SEQ ID NO: 660, please replace "C122S" with —C122S—;

At Column 99, Table 12a, SEQ ID NO: 665, please replace "Q192S" with —Q192S—;

At Column 99, Table 12a, SEQ ID NO: 667, please replace "C122S" with —C122S—;

At Column 99, Table 12a, SEQ ID NO: 668, please replace "C122S" with —C122S—;

At Column 99, Table 12a, SEQ ID NO: 675, please replace "G151S" with —G151S—;

At Column 99, Table 12a, SEQ ID NO: 679, please replace "Y146FN183A" with —Y146F/V183A—;

At Column 101, Table 12b, SEQ ID NO: 28, please replace "Q802DQ175L/Q192D" with —Q802D—;

CERTIFICATE OF CORRECTION (continued)
U.S. Pat. No. 10,781,435 B2

At Column 103, Table 12b, SEQ ID NO: 57, please replace "I6405" with —I640S—;

At Column 103, Table 12b, SEQ ID NO: 59, please replace "I6405" with —I640S—;

At Column 103, Table 12b, SEQ ID NO: 69, please replace "D8281" with —D828I—;

At Column 103, Table 12b, SEQ ID NO: 69, please replace "D2171" with —D217I—;

At Column 105, Table 12b, SEQ ID NO: 80, please replace "F7061" with —F706I—;

At Column 105, Table 12b, SEQ ID NO: 80, please replace "F971" with —F97I—;

At Column 105, Table 12b, SEQ ID NO: 81, please replace "D8281" with —D828I—;

At Column 135, Line 48, please replace "PEG-NETS" with —PEG-NHS—;

At Column 151, Line 64, please replace "Kilda" with —Kikić—;

At Column 155, Line 30, please replace "Mailer et al." with —Maller et al.—;

At Column 160, Line 16, please replace "D3 pellet" with —IB pellet—;

At Column 160, Line 17, please replace "D3" with —IB—;

At Column 160, Line 20, please replace "D3" with —IB—;

At Column 170, Table 15, SEQ ID NO: 32, please replace "D961" with —D96I—;

At Column 171, Table 15, SEQ ID NO: 80, please replace "F971" with —F97I—;

At Column 171, Table 15, SEQ ID NO: 165, please replace "D2171" with —D217I—;

At Column 171, Table 15, SEQ ID NO: 173, please replace "D2171" with —D217I—;

At Column 171, Table 15, SEQ ID NO: 177, please replace "D2171" with —D217I—;

At Column 171, Table 15, SEQ ID NO: 183, please replace "D2171" with —D217I—;

At Column 173, Table 15, SEQ ID NO: 212, please replace "D2171" with —D217I—;

At Column 173, Table 15, SEQ ID NO: 215, please replace "D2171" with —D217I—;

At Column 173, Table 15, SEQ ID NO: 233, please replace "Q1751" with —Q175I—;

At Column 173, Table 15, SEQ ID NO: 251, please replace "Q1751" with —Q175I—;

CERTIFICATE OF CORRECTION (continued)
U.S. Pat. No. 10,781,435 B2

At Column 173, Table 15, SEQ ID NO: 252, please replace "Q175l" with —Q175I—;

At Column 173, Table 15, SEQ ID NO: 253, please replace "Q175l" with —Q175I—;

At Column 173, Table 15, SEQ ID NO: 262, please replace "l136M" with —I136M—;

At Column 175, Table 15, SEQ ID NO: 290, please replace "F60e1" with —F60eI—;

At Column 175, Table 15, SEQ ID NO: 291, please replace "F60e1" with —F60eI—;

At Column 175, Table 15, SEQ ID NO: 302, please replace "F60e1" with —F60eI—;

At Column 175, Table 15, SEQ ID NO: 303, please replace "F60e1" with —F60eI—;

At Column 175, Table 15, SEQ ID NO: 310, please replace "F60e1" with —F60eI—;

At Column 177, Table 15, SEQ ID NO: 333, please replace "F60e1" with —F60eI—;

At Column 177, Table 15, SEQ ID NO: 340, please replace "F60e1" with —F60eI—;

At Column 179, Table 15, SEQ ID NO: 386, please replace "l136T" with —I136T—;

At Column 179, Table 15, SEQ ID NO: 387, please replace "l136V" with —I136V—;

At Column 179, Table 15, SEQ ID NO: 390, please replace "l136V" with —I136V—;

At Column 179, Table 15, SEQ ID NO: 394, please replace "l136T" with —I136T—;

At Column 179, Table 15, SEQ ID NO: 395, please replace "l136V" with —I136V—;

At Column 181, Table 15, SEQ ID NO: 405, please replace "l136V" with —I136V—;

At Column 181, Table 15, SEQ ID NO: 408, please replace "D96l" with —D96I—;

At Column 181, Table 15, SEQ ID NO: 410, please replace "D96l" with —D96I—;

At Column 181, Table 15, SEQ ID NO: 411, please replace "ins97a1" with —ins97aI—;

At Column 181, Table 15, SEQ ID NO: 425, please replace "T98S" with —T98S—;

At Column 181, Table 15, SEQ ID NO: 428, please replace "D96l" with —D96I—;

At Column 181, Table 15, SEQ ID NO: 429, please replace "D96l" with —D96I—;

At Column 181, Table 15, SEQ ID NO: 436, please replace "D96l" with —D96I—;

CERTIFICATE OF CORRECTION (continued)
U.S. Pat. No. 10,781,435 B2

At Column 183, Table 15, SEQ ID NO: 456, please replace "G175L" with —Q175L—;

At Column 185, Table 15, SEQ ID NO: 492, please replace "Q38Y/I41S/D60bT/F60eR/Y60gW/D96M/F97N/T98G/F99L/C122S/75L/Q192DQ1" with —Q38Y/I41S/D60bT/F60eR/Y60gW/D96M/F97N/T98G/F99L/C122S/Q175L/Q192D—;

At Column 185, Table 15, SEQ ID NO: 498, please replace "Q1751" with —Q175I—;

At Column 185, Table 15, SEQ ID NO: 505, please replace "Q1751" with —Q175I—;

At Column 185, Table 15, SEQ ID NO: 506, please replace "Q1751" with —Q175I—;

At Column 185, Table 15, SEQ ID NO: 507, please replace "Q1751" with —Q175I—;

At Column 185, Table 15, SEQ ID NO: 508, please replace "Q1751" with —Q175I—;

At Column 185, Table 15, SEQ ID NO: 510, please replace "Q1751" with —Q175I—;

At Column 185, Table 15, SEQ ID NO: 524, please replace "Q1751" with —Q175I—;

At Column 187, Table 15, SEQ ID NO: 555, please replace "ins97a1" with —ins97aI—;

At Column 189, Table 15, SEQ ID NO: 633, please replace "D961" with —D96I—;

At Column 189, Table 15, SEQ ID NO: 679, please replace "Y146FN183A" with —F146F/V183A—;

At Column 194, Table 16, SEQ ID NO: 29, please replace "D961" with —D96I—;

At Column 194, Table 16, SEQ ID NO: 32, please replace "D961" with —D96I—;

At Column 197, Line 30, please replace "uncleaned" with —uncleaved—;

At Column 197, Line 31, please replace "(Abcam ab11872)" with —anti-huC3a (Abcam ab11872)—;

At Column 198, Table 19, SEQ ID NO: 29, please replace "D961" with —D96I—;

At Column 198, Table 19, SEQ ID NO: 32, please replace "D961" with —D96I—;

At Column 200, Line 7, please replace "C122c1S" with —C122S—;

At Column 201, Line 16, please replace "10" with —10μM—;

CERTIFICATE OF CORRECTION (continued)
U.S. Pat. No. 10,781,435 B2

In the Claims

At Column 211, please replace Claim 8 with the following:
—8. The modified MTSP-1 polypeptide of claim 1, comprising modifications corresponding to any of:
Q38H/I41S/D60bT/F60eS/Y60gW/D96K/F97G/ins97aV/T98P/F99L/C122S/G151H/Q175L/Q192D, or
Q38H/I41A/D60bV/F60eR/Y60gW/F97T/ins97aE/T98G/F99L/C122S/G151N/Q175L/Q192D, or
Q38H/I41A/D60bT/F60eK/Y60gW/F97T/ins97aE/T98G/F99L/C122S/G151N/Q175L/Q192D, or
Q38H/I41S/D60bT/F60eS/Y60gW/F97D/ins97aV/T98P/F99L/C122S/G151H/Q175L/Q192E, or
Q38H/I41S/D60bT/F60eS/Y60gW/F97D/ins97aV/T98P/F99L/C122S/G151H/Q175L/Q192D, or
Q38H/I41A/D60bT/F60eK/Y60gW/F97T/ins97aE/T98G/F99L/C122S/G151H/Q175L/Q192D, or
Q38H/I41S/D60bT/F60eS/Y60gW/F97D/ins97aV/T98P/F99L/C122S/G151N/Q175L/Q192D, or
Q38H/I41A/D60bV/F60eR/Y60gW/F97T/ins97aE/T98G/F99L/C122S/G151H/Q175L/Q192D, or
Q38H/I41A/D60bV/F60eR/Y60gW/D96I/F97Y/ins97aN/T98G/F99L/C122S/G151N/Q175L/Q192D, or
Q38H/I41S/D60bT/F60eS/Y60gW/D96K/F97D/ins97aA/T98P/F99L/C122S/G151H/Q175L/Q192D, or
Q38H/I41A/D60bV/F60eR/Y60gW/D96P/F97W/ins97aN/T98G/F99L/C122S/G151N/Q175L/Q192E, or
Q38H/I41A/D60bV/F60eR/Y60gW/D96I/F97N/T98G/F99L/C122S/G151N/Q175L/Q192D, or
Q38H/I41S/D60bT/F60eS/Y60gW/D96Y/F97E/ins97aV/T98G/F99L/C122S/G151H/Q175L/Q192D, or
Q38H/I41S/D60bT/F60eS/Y60gW/D96L/F97D/ins97aG/T98N/F99L/C122S/G151H/Q175L/Q192E, or
Q38H/I41S/D60bT/F60eS/Y60gW/D96V/F97G/ins97aV/T98P/F99L/C122S/G151H/Q175L/Q192D, or
Q38H/I41S/D60bT/F60eS/Y60gW/D96K/F97D/ins97aA/T98P/F99L/C122S/G151N/Q175L/Q192D, or
Q38H/I41S/D60bT/F60eS/Y60gW/F97G/ins97aV/T98P/F99L/C122S/G151H/Q175L/Q192D, or
Q38H/I41S/D60bT/F60eS/Y60gW/D96K/ins97aV/T98P/F99L/C122S/G151H/Q175L/Q192D, or
Q38H/I41S/D60bT/F60eS/Y60gW/D96K/F97G/ins97aV/T98P/F99L/C122S/G151H/Q175L, or
I41S/F99L/C122S/G151N/Q192V, or
I41S/D60bT/F60eS/Y60gW/D96K/F97G/ins97aV/T98P/F99L/C122S/G151H/Q175L/Q192D, or
Q38H/D60bT/F60eS/Y60gW/D96K/F97G/ins97aV/T98P/F99L/C122S/G151H/Q175L/Q192D, or
Q38H/I41S/F60eS/Y60gW/D96K/F97G/ins97aV/T98P/F99L/C122S/G151H/Q175L/Q192D, or
Q38H/I41S/D60bT/Y60gW/D96K/F97G/ins97aV/T98P/F99L/C122S/G151H/Q175L/Q192D, or
Q38H/I41S/D60bT/F60eS/D96K/F97G/ins97aV/T98P/F99L/C122S/G151H/Q175L/Q192D, or
Q38H/I41S/D60bT/F60eS/Y60gW/D96K/F97G/T98P/F99L/C122S/G151H/Q175L/Q192D, or
Q38H/I41S/D60bT/F60eS/Y60gW/D96K/F97G/ins97aV/F99L/C122S/G151H/Q175L/Q192D, or
Q38H/I41S/D60bT/F60eS/Y60gW/D96K/F97G/ins97aV/T98P/C122S/G151H/Q175L/Q192D, or
Q38H/I41S/D60bT/F60eS/Y60gW/D96K/F97G/ins97aV/T98P/F99L/C122S/Q175L/Q192D, or
Q38H/I41S/D60bT/F60eS/Y60gW/D96K/F97G/ins97aV/T98P/F99L/C122S/G151H/Q192D, or
Q38H/I41S/D96K/F97G/ins97aV/T98P/F99L/C122S/Q192D, or
I41S/D96K/F97G/ins97aV/T98P/F99L/C122S/Q175L/Q192D, or
I41S/D96K/F97G/ins97aV/T98P/F99L/C122S/Q192D, or Q38H/I41S/D96K/F97G/ins97aV/T98P/F99L/C122S/Q175L/Q192D, or
Q38H/I41S/D60bY/D96K/F97G/ins97aV/T98P/F99L/C122S/Q192D/D217V, or
I41S/D96K/F97G/ins97aV/T98P/F99L/C122S/Q192G/D217V, or
I41S/D60bY/D96K/F97G/ins97aV/T98P/F99L/C122S/Q192D/D217V, or
I41S/D96M/F97G/ins97aV/T98P/F99L/C122S/Q192G/D217V, or
I41S/D96K/F97G/ins97aV/T98P/F99L/C122S/Q192V/D217I, or
I41S/D96K/F97G/ins97aV/T98P/F99L/C122S/Q192H, or
I41S/D96K/F97G/ins97aV/T98P/F99L/C122S/Q192N/D217V, or
I41S/D60bY/D96K/F97G/ins97aV/T98P/F99L/C122S/Q175L/Q192D, or
Q38H/I41S/D96K/F97G/ins97aV/T98P/F99L/C122S/Q192G/D217V, or
I41S/D96K/F97G/ins97aV/T98P/F99L/C122S/Q175L/Q192V, or
I41S/P49S/D96K/F97G/ins97aV/T98P/F99L/C122S/Q192G/D217V, or
I41S/D96K/F97G/ins97aV/T98P/F99L/C122S/Q192N/D217V, or
I41T/F97W/F99L/C122S/G151N/Q175M/Q192G/D217L, or
I41G/F97L/F99L/C122S/Q175A/Q192T/D217V, or
I41G/F97V/F99L/C122S/G151Q/Q175M/Q192A/D217L, or
I41G/F97I/F99L/C122S/G151L/Q175M/Q192S/D217V, or
I41G/F97S/F99L/C122S/G151N/Q175L/Q192G/D217I, or
I41T/F97L/F99L/C122S/G151N/Q175S/Q192S/D217W, or
I41D/F97T/F99M/C122S/Q192V/D217M, or the same modifications except C122S is not modified and is C122C, by chymotrypsin numbering—;

At Column 228, please replace Claim 34 with the following:
—34. The method of claim 33, wherein the modified MTSP-1 polypeptide comprises the sequence of amino acid residues set forth in SEQ ID NO:35.—;

At Column 228, please replace Claim 35 with the following:
—35. The method of claim 33, wherein the modified MTSP-1 polypeptide comprises the modifications
Q38H/I41S/D60bT/F60eS/Y60gW/D96K/F97G/ins97aV/T98P/F99L/C122S/G151H/Q175L/Q192D, by chymotrypsin numbering—.